United States Patent 12,508,308 (INFLUENZA mRNA VACCINES) - sequence listing, part 40

SEQ ID NO: 154090 - RNA, 1701 nt, Artificial Sequence; identical to SEQ ID NO: 153953
  derived and/or modified sequence opt4 from hemagglutinin__InfluenzaA__ABO32762

SEQ ID NO: 154091 - RNA, 1701 nt, Artificial Sequence; identical to SEQ ID NO: 153975
  derived and/or modified sequence opt4 from hemagglutinin__InfluenzaA__ABO32775

SEQ ID NO: 154092 - RNA, 1701 nt, Artificial Sequence; identical to SEQ ID NO: 152763
  derived and/or modified sequence opt4 from hemagglutinin__InfluenzaA__ABO32790

SEQ ID NO: 154093 - RNA, 1701 nt, Artificial Sequence
  derived and/or modified sequence opt4 from hemagglutinin__InfluenzaA__ABO32803
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgugagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacacccugcugaucaacagcaccggcaaccugaucgcccccagaggcuacuucaagaucagaagcggcaagagcagcaucaugagaagcgacgcccccaucgacaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154094 - RNA, 1701 nt, Artificial Sequence; identical to SEQ ID NO: 153153
  derived and/or modified sequence opt4 from hemagglutinin__InfluenzaA__ABO32816

SEQ ID NO: 154095 - RNA, 1701 nt, Artificial Sequence; identical to SEQ ID NO: 152776
  derived and/or modified sequence opt4 from hemagglutinin__InfluenzaA__ABO32827

SEQ ID NO: 154096 - RNA, 1701 nt, Artificial Sequence
  derived and/or modified sequence opt4 from hemagglutinin__InfluenzaA__ABO32838
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagagaugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154097 - RNA, 1701 nt, Artificial Sequence; identical to SEQ ID NO: 154096
  derived and/or modified sequence opt4 from hemagglutinin__InfluenzaA__ABO32849

SEQ ID NO: 154098 - RNA, 1701 nt, Artificial Sequence
  derived and/or modified sequence opt4 from hemagglutinin__InfluenzaA__ABO32860
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagagaugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154099 - RNA, 1701 nt, Artificial Sequence; identical to SEQ ID NO: 154081
  derived and/or modified sequence opt4 from hemagglutinin__InfluenzaA__ABO32871

SEQ ID NO: 154100 - RNA, 1701 nt, Artificial Sequence
  derived and/or modified sequence opt4 from hemagglutinin__InfluenzaA__ABO32882
augaagaccaucaucgcccugagcuacaucaucugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccccuacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucagaaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154101 - RNA, 1701 nt, Artificial Sequence
  derived and/or modified sequence opt4 from hemagglutinin__InfluenzaA__ABO32893
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154102 - RNA, 1701 nt, Artificial Sequence; identical to SEQ ID NO: 154101
  derived and/or modified sequence opt4 from hemagglutinin__InfluenzaA__ABO32904

SEQ ID NO: 154103 - RNA, 1701 nt, Artificial Sequence; identical to SEQ ID NO: 153916
  derived and/or modified sequence opt4 from hemagglutinin__InfluenzaA__ABO32915

SEQ ID NO: 154104 - RNA, 1701 nt, Artificial Sequence; identical to SEQ ID NO: 153916
  derived and/or modified sequence opt4 from hemagglutinin__InfluenzaA__ABO32926

SEQ ID NO: 154105 - RNA, 1701 nt, Artificial Sequence
  derived and/or modified sequence opt4 from hemagglutinin__InfluenzaA__ABO32937
augaagaccaucaucgcccugagcuacauccugugccugguguucgcccagaagcugcccggcaacgacaacagcaccgccacccugugccugggccaccacgccgugcccaacggcaccaucgugagaaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcagcugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154106 - RNA, 1698 nt, Artificial Sequence
  derived and/or modified sequence opt4 from hemagglutinin__InfluenzaA__ABO32948
augagagccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154107 - RNA, 1698 nt, Artificial Sequence
  derived and/or modified sequence opt4 from hemagglutinin__InfluenzaA__ABO32959
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcagaagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacacccugaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154108 - RNA, 1698 nt, Artificial Sequence; identical to SEQ ID NO: 153724
  derived and/or modified sequence opt4 from hemagglutinin__InfluenzaA__ABO32970

SEQ ID NO: 154109 - RNA, 1701 nt, Artificial Sequence
  derived and/or modified sequence opt4 from hemagglutinin__InfluenzaA__ABO32981
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagaagcuggcccaagcacaacgugaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucaaggaccagaagaccaucuacagaaaggagaacgccuacgugagcguggugagcagcaacuacaacagaagauucacccccgagaucgccgagagacccaaggugagagaccaggccggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacaccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154110 - RNA, 1701 nt, Artificial Sequence
  derived and/or modified sequence opt4 from hemagglutinin__InfluenzaA__ABO32992
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagaagcuggcccaagcacgacgugaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagcaacuacaacagaagauucacccccgagaucagcgagagacccaaggugagagaccagaagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacaccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154111 - RNA, 1701 nt, Artificial Sequence
  derived and/or modified sequence opt4 from hemagglutinin__InfluenzaA__ABO33006
augaaggccaagauccuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagaagcuggcccaagcacaacgugaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagcaacuacaacagaagauucacccccgagaucagcaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacaccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154112 - RNA, 1701 nt, Artificial Sequence
  derived and/or modified sequence opt4 from hemagglutinin__InfluenzaA__ABO33025
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacaaccacaacggcaagcugugcaagcugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaaccacaacgugaccaagggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucaaggaccagagaaccaucuacagaaaggagaacgccuacgugagcguggugagcagccacuacaacagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagagcgccaucaacggcaucaccaacaaggugaacagcaucaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154113 - RNA, 1701 nt, Artificial Sequence
  derived and/or modified sequence opt4 from hemagglutinin__InfluenzaA__ABO33036
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcaacagcccccaccagauccuggacggcgagaacugcacccugaucgacgcccugcugggcgacccccacugcgacggcuuccagaacaaggagugggaccuguucguggagagaagaaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154114 - RNA, 1701 nt, Artificial Sequence; identical to SEQ ID NO: 152592
  derived and/or modified sequence opt4 from hemagglutinin__InfluenzaA__ABO33047

SEQ ID NO: 154115 - RNA, 1701 nt, Artificial Sequence; identical to SEQ ID NO: 153170
  derived and/or modified sequence opt4 from hemagglutinin__InfluenzaA__ABO33058

SEQ ID NO: 154116 - RNA, 1701 nt, Artificial Sequence
  derived and/or modified sequence opt4 from hemagglutinin__InfluenzaA__ABO33069
augaagaccaucaucgcccugagcuacaucuucugccugguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcuacgccugcaagagaggccccgacaacagcuucuucagcagacugaacuggcuguacgagagcgagagcaaguaccccgugcugaacgugaccaugcccaacaacgacaacuucgacaagcuguacaucuggggcgugcaccaccccagcaccgacaaggagcagaccaaccuguacgugcaggccagcggcagagugaccgugagcaccaagaagagccagcagaccaucauccccaacgugggcagcagacccugggugagaggccugagcagcagaaucagcaucuacuggaccaucgugaagcccggcgacauccugcugaucaacagcaacggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacaucgaggacaccaagaucgaccuguggagcuacaacgccgagcugcugguggcccuggagaaccagcacaccaucgaccugaccgacagcaagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154117 - RNA, 1701 nt, Artificial Sequence; identical to SEQ ID NO: 153441
  derived and/or modified sequence opt4 from hemagglutinin__InfluenzaA__ABO37988

SEQ ID NO: 154118 - RNA, 1701 nt, Artificial Sequence
  derived and/or modified sequence opt4 from hemagglutinin__InfluenzaA__ABO38010
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcgugggcagcggcaucaucaccagcaacgccagcaugggcgacugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacaagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcaagcugaagagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154119 - RNA, 1698 nt, Artificial Sequence
  derived and/or modified sequence opt4 from hemagglutinin__InfluenzaA__ABO38021
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugauccccaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucauccccgagauggccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154120 - RNA, 1698 nt, Artificial Sequence
  derived and/or modified sequence opt4 from hemagglutinin__InfluenzaA__ABO38032
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccgaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagacccccaagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 154121 - RNA, 1698 nt, Artificial Sequence; identical to SEQ ID NO: 153320
  derived and/or modified sequence opt4 from hemagglutinin__InfluenzaA__ABO38043

SEQ ID NO: 154122 - RNA, 1701 nt, Artificial Sequence
  derived and/or modified sequence opt4 from hemagglutinin__InfluenzaA__ABO38054
augaaggccagacugcuggugcugcugugcgcccuggccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccugcugagcgagagaagcuggagcuacaucguggagacccccaacagcgagaacggcaccugcuaccccggcgacuucaucgacuacgaggagcugagagagcagcugagcagcgugagcagcuucgagagauucgagaucuucagcaaggagagcagcuggcccaagcacaacaccaccagaggcgugaccgccgccugcagccacgccggcaagagcagcuucuacagaaaccugcuguggcugaccgagaaggacggcagcuaccccaaccugaacaacagcuacgugaacaagaagggcaaggaggugcuggugcuguggggcgugcaccaccccagcaacaucaaggaccagcagacccuguaccagaaggagaacgccuacgugagcguggugagcagcaacuacaacagaagauucacccccgagaucgccgagagacccaaggugagaggccaggccggcagaaugaacuacuacuggacccugcugaagcccggcgacaccaucauguucgaggccaacggcaaccugaucgcccccugguacgccuucgcccugagcagaggcuucggcagcggcaucaucaccagcaacgccagcaugcacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaaccuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugagaaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154123 - RNA, 1701 nt, Artificial Sequence
  derived and/or modified sequence opt4 from hemagglutinin__InfluenzaA__ABO38065
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagaagcuggcccaagcacaacaucaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagcaacuacaacagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacaccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154124 - RNA, 1701 nt, Artificial Sequence; identical to SEQ ID NO: 152763
  derived and/or modified sequence opt4 from hemagglutinin__InfluenzaA__ABO38076

SEQ ID NO: 154125 - RNA, 1701 nt, Artificial Sequence
  derived and/or modified sequence opt4 from hemagglutinin__InfluenzaA__ABO38087
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacgugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154126 - RNA, 1689 nt, Artificial Sequence
  derived and/or modified sequence opt4 from hemagglutinin__InfluenzaA__ABO38098
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgacaucgccaccagacccaaggugaacggccagggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 154127 - RNA, 1701 nt, Artificial Sequence
  derived and/or modified sequence opt4 from hemagglutinin__InfluenzaA__ABO38230
augaagaccaucaucgcccugagcuacaucuucugccagguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacaacccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucuucaacgagggcuucaacuggaccggcgugacccagaacggcggcagcuacgccugcaagagaggccccgacaacagcuucuucagcagacugaacuggcuguacaagagcgagagcaccuaccccgugcugaacgugaccaugcccaacaacgacaacuucgacaagcuguacaucuggggcgugcaccaccccagcaccgacaaggagcagaccaaccuguacgugcaggccagcggcagagugaccgugagcaccaagagaagccagcagaccaucauccccagcgugggcagcagacccugggugagaggccugagcagcagaaucagcaucuacuggaccaucgugaagcccggcgacgugcugcugaucaacagcaacggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacguggacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154128 - RNA, 1701 nt, Artificial Sequence
  derived and/or modified sequence opt4 from hemagglutinin__InfluenzaA__ABO38241
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacaccugcaagagaggcagcgugaacagcuucuucagcagacugaacuggcuguacgagagcgagagcaaguaccccgcccugaacgugaccaugcccaacaacggcaaguucgacaagcuguacaucuggggcgugcaccaccccagcaccgacaaggagcagaccaaccuguacgugagagccagcggcagagugaccgugagcaccaagagaagccagcagaccgugauccccaacaucggccccagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcggcugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgacaugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154129 - RNA, 1701 nt, Artificial Sequence; identical to SEQ ID NO: 152802
  derived and/or modified sequence opt4 from hemagglutinin__InfluenzaA__ABO38252

SEQ ID NO: 154130 - RNA, 1689 nt, Artificial Sequence
  derived and/or modified sequence opt4 from hemagglutinin__InfluenzaA__ABO38296
auggugaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcacuuccugagcagcgugaagcacuucgagaaggugaagauccugcccaaggacagauggacccagcacaccaccaccggcggcagcagagccugcgccgugagcggcaaccccagcuucuucagaaacaugguguggcugaccaagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgacaucgccaccagacccaaggugaacggccugggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgccaaggagcugggcaacggcugcuucgaguucuaccacaagugcgacgacgagugcaugaacagcgugaagaacggcaccuacuacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 154131 - RNA, 1698 nt, Artificial Sequence; identical to SEQ ID NO: 153390
  derived and/or modified sequence opt4 from hemagglutinin__InfluenzaA__ABO38318

SEQ ID NO: 154132 - RNA, 1698 nt, Artificial Sequence; identical to SEQ ID NO: 153320
  derived and/or modified sequence opt4 from hemagglutinin__InfluenzaA__ABO38329

SEQ ID NO: 154133 - RNA, 1701 nt, Artificial Sequence
  derived and/or modified sequence opt4 from hemagglutinin__InfluenzaA__ABO38351
augaaggccagacugcuggugcugcugugcgcccuggccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgccagaagcuggagcuacaucguggagacccccaacagcgagaacggcaucugcuaccccggcgccuucaucgacuacgaggagcugagagagcagcugagcagcgugagcagcuucgagagauucgagaucuuccccaaggagagcagcuggcccaaccacaacaccaacaucggcgugaccgccgccugcagccacgccggcaagagcagcuucuacagaaaccugcuguggcugaccaagaagggcggcagcuaccccaagcugaagaacagcuacgugaacaagaagggcaaggaggugcuggugcuguggggcauccaccaccccagcaacagcaaggaccagcagacccuguaccagaacgagaacgccuacgugagcguggugagcagcaacuacaacagaagauucacccccgagaucgccgagagacccgaggugagagaccaggccggcagaaugaacuacuacuggacccugcuggagcccggcgacaccaucauguucgaggccaacggcaaccugguggcccccugguacgccuucgcccugagcagaggcuucggcagcggcaucaucaccagcaacgccagcaugcacgagugcaacaccaagugccagaccccccagggcgccaucaacagcagccugcccuuccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaaccuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154134 - RNA, 1701 nt, Artificial Sequence
  derived and/or modified sequence opt4 from hemagglutinin__InfluenzaA__ABO38362
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuggugagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaagcacaacgugaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgagaaccagaagaccaucuacagaaaggagaacgccuacgugagcguggugagcagccacuacaacagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaucgacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154135 - RNA, 1698 nt, Artificial Sequence
  derived and/or modified sequence opt4 from hemagglutinin__InfluenzaA__ABO38373
augaaggccagacugcuggugcugcugugcgcccuggccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccugcugagcgagagaagcuggagcuacaucguggagacccccaacagcgagaacggcaccugcuaccccggcgacuucaucgacuacgaggagcugagagagcagcugagcagcgugagcagcuucgagagauucgagaucuucagcaaggagagcagcuggcccaagcacaccaccggcggcgugaccgccgccugcagccacgccggcaagagcagcuucuacagaaaccugcuguggcugaccgagaaggacggcagcuaccccaaccugaacaacagcuacgugaacaagaagggcaaggaggugcuggugcuguggggcgugcaccaccccagcaacaucaaggaccagcagacccuguaccagaaggagaacgccuacgugagcguggugagcagcaacuacaacagaagauucacccccgagaucgccgagagacccaaggugagaggccaggccggcagaaucaacuacuacuggacccugcugaagcccggcgacaccaucauguucgaggccaacggcaaccugaucgcccccugguacgccuucgcccugagcagaggcuucggcagcggcaucaucaccagcaacgccagcaugcacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaaccuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugagaaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccgccgccagcagccuggugcugcuggugagccugggcgccaucagcuucuggaugugcagcaacggcagccugcagugcagaaucugcaucuga

SEQ ID NO: 154136 - RNA, 1701 nt, Artificial Sequence
  derived and/or modified sequence opt4 from hemagglutinin__InfluenzaA__ABO38384
augaaggccagacugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcauccccccccugcagcugggcaagugcaacaucgccggcuggcugcugggcaaccccgagugcgacagccugcugcccgccagaagcuggagcuacaucguggagacccccaacagcgagaacggcgccugcuaccccggcgacuucaucaacuacgaggagcugagagagcagcugagcagcgugagcagcuucgagagauucgagaucuuccccaaggagagcagcuggcccaagcacaacaccaccaagggcgugaccgccgccugcagccacgccggcaagagcagcuucuacagaaaccugcuguggcugaccaagaaggaggacagcuaccccaagcugaagaacagcuacgugaacaagaagggcaaggaggugcuggugcuguggggcgugcaccaccccagcagcagcaaggagcagcagacccuguaccagaacgagaacgccuacgugagcguggugagcagcaacuacaacagaagauucacccccgagaucgccgagagacccaaggugagagaccagaccggcagaaugaacuacuacuggacccugcuggagcccggcgacaccaucaucuucgaggccaacggcaaccugaucgcccccugguacgccuucgcccugagcagaggcuucggcagcggcaucaucaccagcaacgccagcaugcacgagugcaacaccaagugccagaccccccagggcgccaucaacagcagccugcccuuccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaaccuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154137 - RNA, 1701 nt, Artificial Sequence
  derived and/or modified sequence opt4 from hemagglutinin__InfluenzaA__ABO38395
augaaggccaagcugcuggugcugcugugcgccuucaccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaagggcagaagcagcuucuacagaaaccugcuguggcugaccaagaagaacggcagcuaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacaacagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154138 - RNA, 1701 nt, Artificial Sequence
  derived and/or modified sequence opt4 from hemagglutinin__InfluenzaA__ABO38406
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacaaccacaacggcaagcugugcaagcugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaaccacaacgugaccaagggcgugaccgccagcugcagccacaagggcaagagcagcuucuacagaaaccugcuguggcugaccgagaagaagggcagcuaccccaaccugagcaagagcuacgugaacaacaaggagaaggaggugcuggugcuguggggcauccaccaccccagcaacaucgaggaccagaagaccaucuacagaaaggagaacgccuacgugagcguggugagcagccacuacaacagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagacccccagaggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagagcgccaucaacggcaucaccaacaaggugaacagcaucaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154139 - RNA, 1701 nt, Artificial Sequence
  derived and/or modified sequence opt4 from hemagglutinin__InfluenzaA__ABO38417
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagccccaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacacccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154140 - RNA, 1689 nt, Artificial Sequence
  derived and/or modified sequence opt4 from hemagglutinin__InfluenzaA__ABO38712
auggccaucaucuacuucauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacagccugugcuaccccggcagcuucaacgacuacgaggagcugaagcaccugcugagcagcgugaagcacuucgagaaggugagaauccugcccaaggacggcuggacccagcacaccaccagcggcggcagcaaggccugcgccgugagcggcaagagcagcuucuucagaaacaugguguggcugaccaagaagggccccaacuaccccguggccaagagaagcuacaacaacaccagcggcgagcagaugcugaucaucuggggcgugcaccaccccaaggacgaggccgagcagagagcccuguaccagaaggugggcaccuacgugagcgccagcaccagcacccugaacaagagaagcacccccgagaucgccgccagacccgaggugaacggccugggcagcagaauggaguucagcuggacccugcuggacgugugggacaccaucaacuucgagagcaccggcaaccugguggcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacagaaucaccaacaaggugaacagcgugaucgagaagaugaacacccaguucgaggccgugggcaaggaguucagcaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacaacaaggugagaaugcagcugagagacaacgugaaggagcugggcaacggcugcuucgaguucuaccacaagugcgacgacgagugcaugagcagcgugaagaacggcaccuacgacuaccccaaguacgaggaggagagcaagcugaagagaaacgagaucaagggcgugaagcugagcagcaugggcguguaccagauccuggccaucuacgccaccguggccggcagccugagccuggccaucaugaucgccggcaucagccuguggaugugcagcaacggcagccugcagugcagaaucugcaucuga

SEQ ID NO: 154141 - RNA, 1689 nt, Artificial Sequence
  derived and/or modified sequence opt4 from hemagglutinin__InfluenzaA__ABO38723
auggccaucaucuacuucauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacagccugugcuaccccggcagcuucaacgacuacgaggagcugaagcaccugcugagcagcgugaagcacuucgagaaggugagaauccugcccaaggacggcuggacccagcacaccaccagcggcggcagcaaggccugcgccgugagcggcaagagcagcuucuucagaaacaugguguggcugaccaagaagggccccaacuaccccguggccaagagaagcuacaacaacaccagcggcgagcagaugcugaucaucuggggcgugcaccaccccaacgacgaggccgagcagagagcccuguaccagaaggugggcaccuacgugagcgccagcaccagcacccugaacaagagaagcacccccgagaucgccgccagacccgaggugaacggccugggcagcagaauggaguucagcuggacccugcuggacgugugggacaccaucaacuucgagagcaccggcaaccugguggcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacagaaucaccaacaaggugaacagcgugaucgagaagaugaacacccaguucgaggccgugggcaaggaguucagcaaccuggagaagagacugggcaaccugaacaagaagauggaggacggcuuccuggacguguggaccuacaacgccgagcugcuggugcugauggagaacgagagaacccuggacuuccacgacagcaacgugaagaaccuguacaacaaggugagaaugcagcugagagacaacgugaaggagcugggcaacggcugcuucgaguucuaccacaagugcgacgacgagugcaugagcagcgugaagaacggcaccuacgacuaccccaaguacgaggaggagagcaagcugaagagaaacgagaucaagggcgugaagcugagcagcaugggcguguaccagauccuggccaucuacgccaccguggccggcagccugagccuggccaucaugaucgccggcaucagccuguggaugugcagcaacggcagccugcagugcagaaucugcaucuga

SEQ ID NO: 154142 - RNA, 1698 nt, Artificial Sequence
  derived and/or modified sequence opt4 from hemagglutinin__InfluenzaA__ABO44046
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaagaugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154143 - RNA, 1689 nt, Artificial Sequence
  derived and/or modified sequence opt4 from hemagglutinin__InfluenzaA__ABO44057
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacagccugugcuaccccggcagcuucaacgacuacgaggagcugaagcaccugcugagcagcgugaagcacuucgagaaggugaagauccugcccaaggacggcuggacccagcacgagaccgacggcggcagcaaggccugcgccgugagcggcaaggccagcuucuucagaaacaugguguggcugaccaagagaggccccaacuaccagguggccaagagaagcuacaacaacaccagcggcgagcagaugcugaucaucuggggcgugcaccaccccaaggacgaggccgagcagagagcccuguaccagaaggugggcaccuacgugagcgccagcaccagcacccugaacaagagaagcacccccgagaucgccgccagacccgaggugaacggccuggagagcagaauggaguucagcuggacccugcuggacgugugggacaccaucaacuucgagagcaccggcaaccugguggcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacagaaucaccaacaaggugaacagcgugaucgagaagaugaacauccaguucgaggccgugggcaaggaguucagcaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaagagaaacgagaucaagggcgugaagcugagcagcaugggcguguaccagauccuggccaucuacgccaccguggccggcagccugagccuggccaucaugaucgccggcaucagcuucuggaugugcagcaacggcagccugcagugcagagugugcaucuga

SEQ ID NO: 154144 - RNA, 1701 nt, Artificial Sequence; identical to SEQ ID NO: 152776
  derived and/or modified sequence opt4 from hemagglutinin__InfluenzaA__ABO44079

SEQ ID NO: 154145 - RNA, 1689 nt, Artificial Sequence
  derived and/or modified sequence opt4 from hemagglutinin__InfluenzaA__ABO44090
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugaucuggcugaccaagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcguggugaccagcacccugaacaagagaagcacccccaagaucgccaccagacccaaggugaacggccugggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagagagccuucgacggcaucaccaacaaggugaacagcgugaucgagaagaugaacacccaguucgaggccgugggcaaggaguucagcaaccuggagagaagacuggagaaccugaacaagaagauggaggacggccugcuggacguguggaccuacaacgccgagcugcuggugcugauggagaacgagagaauccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 154146 - RNA, 1689 nt, Artificial Sequence
  derived and/or modified sequence opt4 from hemagglutinin__InfluenzaA__ABO44101
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacagccugugcuaccccggcagcuucaacgacuacgaggagcugaagcaccugcugagcagcgugaagcacuucgagaaggugaagauccugcccaaggacggcuggacccagcacaagaccgacggcggcagcaaggccugcgccgugagcggcaagcccagcuucuucagaaacaugguguggcugaccaagaagggccccaacuaccccguggccaagagaagcuacaacaacaccagcggcgagcagaugcugaucaucuggggcgugcaccaccccaacgacgaggccgagcagagagcccuguaccagaaggugggcaccuacgugagcgccagcaccagcacccugaacaagagaagcacccccgagaucgccgccagacccgaggugagcggccugggcagcagaauggaguucagcuggacccugcuggacgugugggacaccaucagcuucgagagcaccggcaaccugguggcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacagaaucaccaacaaggugaacagcgugaucgagaagaugaacacccaguucgaggccgugggcaaggaguucagcaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaagagaaacgagaucaagggcgugaagcugagcagcaugggcguguaccagauccuggccaucuacgccaccguggccggcagccugagccuggccaucaugaucgccggcaucagcuucuggaugugcagcaacggcagccugcagugcagaaucugcaucuga

SEQ ID NO: 154147 - RNA, 1701 nt, Artificial Sequence
  derived and/or modified sequence opt4 from hemagglutinin__InfluenzaA__ABO44123
augaaggccaagcugcuggugcugcugugcgccuucaccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaagggcaagagcagcuucuacagaaaccugcuguggcugaccaagaagaacggcagcuaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacaacagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154148 - RNA, 1701 nt, Artificial Sequence
  derived and/or modified sequence opt4 from hemagglutinin__InfluenzaA__ABO44134
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagaagcuggcccaagcacaacgugaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagcaacuacaacagaagauucacccccgagaucgccgagagacccaaggugagaggccaggccggcagaaucaacuacuacuggacccugcuggagcccggcgacaccaucaucuucgaggccaacggcaaccugaucgcccccuggcacgccuucgcccugagcagaggcuucggcagcggcaucaucaccagcaacgccagcauggacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154149 - RNA, 1701 nt, Artificial Sequence
  derived and/or modified sequence opt4 from hemagglutinin__InfluenzaA__ABO52071
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccagcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154150 - RNA, 1701 nt, Artificial Sequence
  derived and/or modified sequence opt4 from hemagglutinin__InfluenzaA__ABO52225
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugaaggagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacaagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugaagagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154151 - RNA, 1689 nt, Artificial Sequence
  derived and/or modified sequence opt4 from hemagglutinin__InfluenzaA__ABO52236
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcacuuccugagcagcgugaagcacuucgagaaggugaagauccugcccaaggacagauggacccagcacaccaccaccggcggcagcagagccugcgccgugagcggcaaccccagcuucuucagaaacaugguguggcugaccaagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgacaucgccaccagacccaaggugaacggccugggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgccaaggagcugggcaacggcugcuucgaguucuaccacaagugcgacgacgagugcaugaacagcgugaagaacggcaccuacuacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 154152 - RNA, 1689 nt, Artificial Sequence
  derived and/or modified sequence opt4 from hemagglutinin__InfluenzaA__ABO52247
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacagccugugcuaccccggcagcuucaacgacuacgaggagcugaagcaccugcugagcagcgugaagcacuucgagaaggugaagauccugcccaaggacggcuggacccagcacaagaccgacggcggcagcaaggccugcgccgugagcggcaagcccagcuucuucagaaacaugguguggcugaccaagaagggccccaacuaccccguggccaagagaagcuacaacaacaccagcggcgagcagaugcugaucaucuggggcgugcaccaccccaacgacgaggccgagcagagagcccuguaccagaaggugggcaccuacgugagcgccagcaccagcacccugaacaagagaagcacccccgagaucgccgccagacccgaggugagcggccugggcagcagaauggaguucagcuggacccugcuggacgugugggacaccaucagcuucgagagcaccggcaaccugguggcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccccagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacagaaucaccaacaaggugaacagcgugaucgagaagaugaacacccaguucgaggccgugggcaaggaguucagcaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaagagaaacgagaucaagggcgugaagcugagcagcaugggcguguaccagauccuggccaucuacgccaccguggccggcagccugagccuggccaucaugaucgccggcaucagcuucuggaugugcagcaacggcagccugcagugcagaaucugcaucuga

SEQ ID NO: 154153 - RNA, 1701 nt, Artificial Sequence
  derived and/or modified sequence opt4 from hemagglutinin__InfluenzaA__ABO52258
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaagcacaacgugaccagaggcgugaccgccagcugcagccacaagggcaagugcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagccacuacaacagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154154 - RNA, 1701 nt, Artificial Sequence
  derived and/or modified sequence opt4 from hemagglutinin__InfluenzaA__ABO52280
augaaggccagacugcugauccugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccugcugagcaacagaagcuggagcuacaucgccgagacccccaacagcgagaacggcaucugcuaccccggcgacuucgccgacuacgaggagcugagagagcagcugagcagcgugagcagcuucgagagauucgagaucuuccccaaggagagcagcuggcccaagcacaacaucaccagaggcgugaccguggccugcagccacgccaagaagagcagcuucuacaagaaccugcuguggcugaccgaggccaacggccuguaccccagccugagcaagagcuacgugaacgacagagagaaggaggugcuggugcuguggggcgugcaccaccccagcaacaucgaggaccagagaacccuguacagaaaggagaacgccuacgugagcguggugagcagcaacuacaacagaagauucacccccgagaucgccgagagacccaaggugagaggccagcccggcagaaugaacuacuacuggacccugcuggagcccggcgacaagaucaucuucgaggccaacggcaaccugaucgcccccugguacgccuucgcccugagcagaggccccggcagcggcaucaucaccagcaacgccagcauggacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugagaaacaacgccaaggagaucggcaacggcugcuucgaguucuaccacaagugcgacaacgagugcauggagagcgugaagaacggcaccuacgacuaccccaaguacagcgaggagagcaagcugaacagagccaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154155 - RNA, 1689 nt, Artificial Sequence
  derived and/or modified sequence opt4 from hemagglutinin__InfluenzaA__ABO52302
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcaacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgacaucgccaccagacccaaggugaacggccugggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcaucuaccagauccuggccaucuacgccaccguggccggcagccugagccuggccaucaugauggccggcaucagcuucuggaugugcagcaacggcagccugcagugcagaaucugcaucuga

SEQ ID NO: 154156 - RNA, 1701 nt, Artificial Sequence
  derived and/or modified sequence opt4 from hemagglutinin__InfluenzaA__ABO52313
augaagaccaucaucgcccugagcuacaucuucugccugguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcaacgccugcaagagaggccccgacagcggcuucuucagcagacugaacuggcuguacaagagcggcagcaccuaccccgugcugaacgugaccaugcccaacaacgacaacuucgacaagcuguacaucuggggcgugcaccaccccagcaccgaccaggagcagaccaaccuguacgugcaggccagcggcagagugaccgugagcaccaagagaagccagcagaccaucauccccaacgugggcagcagacccugggugagaggccugagcagcagaaucagcaucuacuggaccaucgugaagcccggcgacauccuggugaucaacagcaacggcaaccugaucgcccccagaggccacuucaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacacagaaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154157 - RNA, 1701 nt, Artificial Sequence
  derived and/or modified sequence opt4 from hemagglutinin__InfluenzaA__ABO52335
augaagaccaucaucgcccugagcuacaucuucugccuggugcugggccaggacuuccccagaaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaacgagggcuucaccuggaccggcgugacccagaacggcggcagcaacgccugcaagagaggccccgacagcggcuucuucagcagacugaacuggcuguacaagagcggcaacaccuaccccgugcugaacgugaccaugcccaacaacgacaacuucgacaagcuguacaucuggggcgugcaccaccccagcaccgaccaggaccagaccagccuguacgugcaggccagcggcagagugaccgugagcaccaagagaagccagcagaccgugauccccaacaucggccccagacccugggugagaggccugagcagcagaaucagcaucuacuggaccaucgugaagcccggcgacauccugcugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacagaugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154158 - RNA, 1701 nt, Artificial Sequence
  derived and/or modified sequence opt4 from hemagglutinin__InfluenzaA__ABO52346
augaagaccaucaucgcccugagcuacaucuucugccugguguucgcccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacaacccccacagaauccuggacggcaucaacugcacccugaucgacgcccugcugggcgacccccacugcgacggcuuccagaacgagaagugggaccuguucguggagagaagcaaggccuucagcgacugcuaccccuacgacgugcccgacuacgccagccugagaagccugguggccagcagcggcacccuggaguucaucaacgagggcuucaacuggaccggcgugacccagaacggcggcagcagcgccugcaagagaggccccgacaacggcuucuucagcagacugaacuggcuguacaagagcggcagcaccuaccccgugcagaacgugaccaugcccaacaacgacaacagcgacaagcuguacaucuggggcgugcaccaccccagcaccgacaaggagcagaccgaccuguacgugcaggccagcggcaaggugaccgugagcaccaagagaagccagcagaccgugauccccaacgugggcagcagacccugggugagaggccugagcagcagagugagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154159 - RNA, 1701 nt, Artificial Sequence
  derived and/or modified sequence opt4 from hemagglutinin__InfluenzaA__ABO52357
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucuucgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154160 - RNA, 1701 nt, Artificial Sequence
  derived and/or modified sequence opt4 from hemagglutinin__InfluenzaA__ABO52368
augaagaccaucaucgcccugagcuacaucuucugccuggcccugggccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucaacugcacccugaucgacgcccugcugggcgacccccacugcgacguguuccaggacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154161 - RNA, 1701 nt, Artificial Sequence
  derived and/or modified sequence opt4 from hemagglutinin__InfluenzaA__ABO52797
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacaaccacaacggcaagcugugcaagcugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaaccacaacgugaccaagggcgugaccgccagcugcagccacaagggcaagagcagcuucuacagaaaccugcuguggcugaccgagaagaacggcagcuaccccagccugagcaagagcuacgugaacaacaaggagaaggaggugcuggugcuguggggcgugcaccaccccagcaacaucaaggaccagaagaccaucuacagaaaggagaacgccuacgugagcguggugagcagccacuacaacagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagagcgccaucaacggcaucaccaacaaggugaacagcaucaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154162 - RNA, 1698 nt, Artificial Sequence; identical to SEQ ID NO: 153262
  derived and/or modified sequence opt4 from hemagglutinin__InfluenzaA__ABP49217

SEQ ID NO: 154163 - RNA, 1698 nt, Artificial Sequence
  derived and/or modified sequence opt4 from hemagglutinin__InfluenzaA__ABP49305
augaaggccaagcugauggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154164 - RNA, 1701 nt, Artificial Sequence
  derived and/or modified sequence opt4 from hemagglutinin__InfluenzaA__ABP49316
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagaagcuggcccaagcacaacaucaccagaggcgugaccgccgccugcagccacaagggcaagagcagcuucuacagaaaccugcuguggcugaccgagaagaacggcagcuaccccaaccugaagaagagcuacgugaacaacaaggagaaggaggugcuggugcuguggggcgugcaccaccccagcaacaucgaggaccagaagacccuguacagaaaggagaacgccuacgugagcguggugagcagcaacuacaacaagagauucacccccgagaucgccgagagacccaaggugagaggccaggccggcagaaucaacuacuacuggacccugcuggagcccggcgacaccaucaucuucgaggccaacggcaaccugaucgcccccuggcacgccuucgcccugagcagaggcuucggcagcggcaucaucaccagcaacgccagcauggacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154165 - RNA, 1701 nt, Artificial Sequence
  derived and/or modified sequence opt4 from hemagglutinin__InfluenzaA__ABP49327
augaaggccagacugcuggugcugcugugcgcccuggccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugagaaagugcaacaucgccggcuggauccugggcaaccccgagugcgagagccugcugagcgagagaagcuggagcuacaucguggagacccccaacagcgagaacggcaccugcuaccccggcgacuucaccaacuacgaggagcugagagagcagcugagcagcgugagcagcuucgagagauucgagaucuuccccaaggagagcagcuggcccaagcacaacaccaccagaggcgugaccgccgccugcagccacgccggcaagagcagcuucuacagaaaccugcuguggcugaccgagaaggacggcagcuaccccaaccugaacaacagcuacgugaacaagaagggcaaggaggugcuggugcuguggggcgugcaccaccccagcaacaucaaggaccagcagacccuguaccagaaggagaacgccuacgugagcguggugagcagcaacuacaacagaagauucacccccgagaucgccgagagacccaaggugagaggccaggccggcagaaugaacuacuacuggacccugcugaagcccggcgacaccaucauguucgaggccaacggcaaccugaucgcccccugguacgccuucgcccugagcagaggcuucggcagcggcaucaucaccagcaacgccagcaugcacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaaccuggagaagagaauggagaaccugaacaagaagguggacgacggcuuccuggacaucuggaccuacaacgccgagcugcugauccugcuggagaacgagagaacccuggacuuccacgacagcaacgugaagaaccuguacgagaaggugaagagccagcugagaaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154166 - RNA, 1701 nt, Artificial Sequence
  derived and/or modified sequence opt4 from hemagglutinin__InfluenzaA__ABP49338
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagaagcuggcccaagcacaacgugaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagcaacuacaacagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacaccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154167 - RNA, 1701 nt, Artificial Sequence
  derived and/or modified sequence opt4 from hemagglutinin__InfluenzaA__ABP49349
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacaaccacaacggcaagcugugcaagcugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaaccacaacgugaccaagggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcauccaccaccccagcaacaucgaggaccagaagaccaucuacagaaaggagaacgccuacgugagcguggugagcagccacuacaacagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccugggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagagcgccaucaacggcaucaccaacaaggugaacagcaucaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154168 - RNA, 1701 nt, Artificial Sequence
  derived and/or modified sequence opt4 from hemagglutinin__InfluenzaA__ABP49360
augaaggccaagcugcugauccugcugugcgccuucaccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacagaaaccugcuguggcugaccaagaagaacggcagcuaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacaacagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154169 - RNA, 1701 nt, Artificial Sequence; identical to SEQ ID NO: 153170
  derived and/or modified sequence opt4 from hemagglutinin__InfluenzaA__ABP49371

SEQ ID NO: 154170 - RNA, 1701 nt, Artificial Sequence; identical to SEQ ID NO: 153907
  derived and/or modified sequence opt4 from hemagglutinin__InfluenzaA__ABP49382

SEQ ID NO: 154171 - RNA, 1698 nt, Artificial Sequence
  derived and/or modified sequence opt4 from hemagglutinin__InfluenzaA__ABP49393
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcauccaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagagaaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154172 - RNA, 1701 nt, Artificial Sequence
  derived and/or modified sequence opt4 from hemagglutinin__InfluenzaA__ABP49404
augaagaccaucaucgcccugagcuacacccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucggcgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154173 - RNA, 1701 nt, Artificial Sequence; identical to SEQ ID NO: 153170
  derived and/or modified sequence opt4 from hemagglutinin__InfluenzaA__ABP49415

SEQ ID NO: 154174 - RNA, 1701 nt, Artificial Sequence; identical to SEQ ID NO: 153170
  derived and/or modified sequence opt4 from hemagglutinin__InfluenzaA__ABP49426

SEQ ID NO: 154175 - RNA, 1689 nt, Artificial Sequence
  derived and/or modified sequence opt4 from hemagglutinin__InfluenzaA__ABP49437
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgagaucgccaccagacccaaggugaacggccugggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 154176 - RNA, 1701 nt, Artificial Sequence
  derived and/or modified sequence opt4 from hemagglutinin__InfluenzaA__ABP49448
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagaagcuggcccaagcacaacgugaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagcaacuacaacagaagauucacccccgagaucagcgagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacaccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154177 - RNA, 1689 nt, Artificial Sequence
  derived and/or modified sequence opt4 from hemagglutinin__InfluenzaA__ABP49459
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcacccccacccugaacaagagaagcacccccgacaucgccaccagacccaaggugaacggccagggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 154178 - RNA, 1689 nt, Artificial Sequence
  derived and/or modified sequence opt4 from hemagglutinin__InfluenzaA__ABP49470
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugagcaccagcacccugaacaagagaagcacccccgacaucgccaccagacccaaggugaacggccugggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 154179 - RNA, 1701 nt, Artificial Sequence
  derived and/or modified sequence opt4 from hemagglutinin__InfluenzaA__ABP49492
augaagaccaucaucgcccugagcuacaucuucugccugguguucgcccagggccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcagcagcugcaagagaggccccgacaacggcuucuucagcagacugaacuggcuguacaagagcggcagcaccuaccccgugcagaacgugaccaugcccaacaacgacaacagcgacaagcuguacaucuggggcgugcaccaccccagcaccgacaaggagcagaccgaccuguacgugcaggccagcggcaaggugaccgugagcaccaagagaagccagcagaccgugauccccaacgugggcagcagacccugggugagaggccugagcagcagagugagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154180 - RNA, 1701 nt, Artificial Sequence; identical to SEQ ID NO: 154076
  derived and/or modified sequence opt4 from hemagglutinin__InfluenzaA__ABP49503

SEQ ID NO: 154181 - RNA, 1701 nt, Artificial Sequence
  derived and/or modified sequence opt4 from hemagglutinin__InfluenzaA__ABP49514
augaagaccaucaucgcccugagcuacaucuucuaccuggcccugggccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154182 - RNA, 1701 nt, Artificial Sequence
  derived and/or modified sequence opt4 from hemagglutinin__InfluenzaA__ABQ01311
augaaggccagacugcugauccugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccugcugagcaacagaagcuggagcuacaucgccgagacccccaacagcgagaacggcaccugcuaccccggcgacuucgccgacuacgaggagcugagagagcagcugagcagcgugagcagcuucgagagauucgagaucuuccccaaggagagaagcuggcccaagcacaacaucaccagaggcgugaccgccgccugcagccacgccaagaagagcagcuucuacaagaaccugcuguggcugaccgaggccaacggcagcuaccccaaccugagcaagagcuacgugaacaacaaggagaaggaggugcuggugcuguggggcgugcaccaccccagcaagaucgaggaccagagaacccuguacagaaaggagaacgccuacgugagcguggugagcagcaacuacaacagaagauucacccccgagaucgccgagagacccaaggugagaggccaggccggcagaaugaacuacuacuggacccugcuggagcccggcgacaagaucaucuucgaggccaacggcaaccugaucgcccccugguacgccuucgcccugagcagaggccugggcagcggcaucaucaccagcaacgccagcauggacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugagaaacaacgccaaggagaucggcaacggcugcuucgaguucuaccacaagugcgacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154183 - RNA, 1701 nt, Artificial Sequence
  derived and/or modified sequence opt4 from hemagglutinin__InfluenzaA__ABQ01322
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcaccugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagaagcuggcccaagcacaacgugaccagaggcgugaccgccgccugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagcaacuacaacagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154184 - RNA, 1701 nt, Artificial Sequence; identical to SEQ ID NO: 153170
  derived and/or modified sequence opt4 from hemagglutinin__InfluenzaA__ABQ01333

SEQ ID NO: 154185 - RNA, 1701 nt, Artificial Sequence
  derived and/or modified sequence opt4 from hemagglutinin__InfluenzaA__ABQ01344
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154186 - RNA, 1689 nt, Artificial Sequence
  derived and/or modified sequence opt4 from hemagglutinin__InfluenzaA__ABQ01355
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagagacggccugugcuaccccggcagcuucaacgacuacgaggagcugaagcaccugcugagcagcgugaagcacuucgagaaggugagaauccugcccaaggacagauggacccagcacaccaccaccggcggcagcagagccugcgccgugagcggcaaccccagcuucuucagaaacaugaucuggcugaccaagaagggcagcaacuaccccguggccaagggcagcuacaacaacaccagcggcgagcagaugcugaucaucuggggcgugcaccaccccaucgacgagaccgagcagagaacccuguaccagaacguggagaccuacgugagcguggugaccagcacccugaacaagagaagcacccccaagaucgccaccagacccaaggugaacggccugggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagagagccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 154187 - RNA, 1701 nt, Artificial Sequence
  derived and/or modified sequence opt4 from hemagglutinin__InfluenzaA__ABQ01366
augaagaccaucaucgcccugagcuacaucuucugccugguguucgcccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcagcgccugcaagagaggccccgacaacggcuucuucagcagacugaacuggcuguacaagagcggcagcaccuaccccgugcagaacgugaccaugaccaacaacgacaacagcgacaagcuguacaucuggggcgugcaccaccccagcaccgacaaggagcagaccgaccuguacgugcaggccagcggcaaggugaccgugagcaccaagagaagccagcagaccaucauccccaacgugggcagcagacccugggugagaggccugagcagcagagugagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154188 - RNA, 1701 nt, Artificial Sequence; identical to SEQ ID NO: 153953
  derived and/or modified sequence opt4 from hemagglutinin__InfluenzaA__ABQ44383

SEQ ID NO: 154189 - RNA, 1701 nt, Artificial Sequence; identical to SEQ ID NO: 153153
  derived and/or modified sequence opt4 from hemagglutinin__InfluenzaA__ABQ44405

SEQ ID NO: 154190 - RNA, 1701 nt, Artificial Sequence
  derived and/or modified sequence opt4 from hemagglutinin__InfluenzaA__ABQ44416
augaaggccaagcugcuggugcugcugugcgccuucaccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacaacagaagauucacccccgagaucgccaagagacccaaggugagagaccaggagggcagaaucaacuacuacuggacccugcuggagcccgaggacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154191 - RNA, 1701 nt, Artificial Sequence; identical to SEQ ID NO: 152776
  derived and/or modified sequence opt4 from hemagglutinin__InfluenzaA__ABQ44427

SEQ ID NO: 154192 - RNA, 1689 nt, Artificial Sequence
  derived and/or modified sequence opt4 from hemagglutinin__InfluenzaA__ABQ44438
auggccaucaucuacuucauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucaccggcuggcugcugggcaaccccgagugcgacagacugcugagagugcccgaguggagcuacaucauggagaaggagaaccccagauacagccugugcuaccccggcagcuucaacgacuacgaggagcugaagcaccugcugagcagcgugaagcacuucgagaaggugagaauccugcccaaggacggcuggacccagcacaccaccagcggcggcagcaaggccugcgccgugagcggcaagagcagcuucuucagaaacaugguguggcugaccaagaagggccccaacuaccccguggccaagagaagcuacaacaacaccagcggcgagcagaugcugaucaucuggggcgugcaccaccccaacgacgaggccgagcagagcgcccuguaccagaaggugggcaccuacgugagcgccagcaccagcacccugaacaagagaagcacccccgagaucgccgccagacccgaggugaacggccugggcagcagaauggaguucagcuggacccugcuggacgugugggacaccaucaacuucgagagcaccggcaaccugguggcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacagaaucaccaacaaggugaacagcgugaucgagaagaugaacacccaguucgaggccgugggcaaggaguucagcaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacaacaaggugagaaugcagcugagagacaacgugaaggagcugggcaacggcugcuucgaguucuaccacaagugcgacgacgagugcaugagcagcgugaagaacggcaccuacgacuaccccaaguacgaggaggagagcaagcugaagagaaacgagaucaagggcgugaagcugagcagcaugggcguguaccagauccuggccaucuacgccaccguggccggcagccugagccuggccaucaugaucgccggcaucagccuguggaugugcagcaacggcagccugcagugcagaaucugcaucuga

SEQ ID NO: 154193 - RNA, 1689 nt, Artificial Sequence
  derived and/or modified sequence opt4 from hemagglutinin__InfluenzaA__ABQ44460
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugaucuggcugaccaagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgacaucgccaccagacccaaggugaacggccugggcagcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 154194 - RNA, 1701 nt, Artificial Sequence
  derived and/or modified sequence opt4 from hemagglutinin__InfluenzaA__ABQ44471
augaaggccagacugcugauccugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccugcugagcaacagaagcuggagcuacaucgccgagacccccaacagcgagaacggcaccugcuaccccggcgacuucgccgacuacgaggagcugagagagcagcugagcagcgugagcagcuucgagagauucgagaucuuccccaaggagagaagcuggcccaagcacaacaucaccagaggcgugaccgccgccugcagccacgccaagaagagcagcuucuacaagaaccugcuguggcugaccgaggccaacggcagcuaccccaaccugagcaagagcuacgugaacaacaaggagaaggaggugcuggugcuguggggcgugcaccaccccagcaacaucgaggaccagagaacccuguacagaaaggagaacgccuacgugagcguggugagcagcaacuacaacagaagauucacccccgagaucgccgagagacccaaggugagaggccaggccggcagaaugaacuacuacuggacccugcuggagcccggcgacaagaucaucuucgaggccaacggcaaccugaucgcccccugguacgccuucgcccugagcagaggccugggcagcggcaucaucaccagcaacgccagcauggacgagugcgacaccaagugccagaccccccagggcgccaucaacaacagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugagaaacaacgccaaggagaucggcaacggcugcuucgaguucuaccacaagugcgacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154195 - RNA, 1701 nt, Artificial Sequence
  derived and/or modified sequence opt4 from hemagglutinin__InfluenzaA__ABR15797
augaagaccaucaucgcccugagcuacaucuucugccuggcccugggccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154196 - RNA, 1701 nt, Artificial Sequence
  derived and/or modified sequence opt4 from hemagglutinin__InfluenzaA__ABR15808
augaaggccagacugcugauccugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccugcugagcaacagaagcuggagcuacaucgccgagacccccaacagcgagaacggcaccugcuaccccggcgacuucgccgacuacgaggagcugagagagcagcugagcagcgugagcagcuucgagagauucgagaucuuccccaaggagagaagcuggcccaagcacaacaucaccagaggcgugaccgccgccugcagccacgccaagaagagcagcuucuacaagaaccugcuguggcugaccgaggccaacggcagcuaccccaaccugagcaagagcuacgugaacaacaaggagaaggaggugcuggugcuguggggcgugcaccaccccagcaacaucgaggaccagagaacccuguacagaaaggagaacgccuacgugagcguggugagcagcaacuacaacagaagauucacccccgagaucgccgagagacccaaggugagaggccaggccggcagaaugaacuacuacuggacccugcuggagcccggcgacaagaucaucuucgaggccaacggcaaccugaucgcccccugguacgccuucgcccugagcagaggccugggcagcggcaucaucaccagcaacgccagcauggacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugagaaacaacgccaaggagaucggcaacggcugcuucgaguucuaccacaagugcgacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154197 - RNA, 1698 nt, Artificial Sequence; identical to SEQ ID NO: 153262
  derived and/or modified sequence opt4 from hemagglutinin__InfluenzaA__ABR15885

SEQ ID NO: 154198 - RNA, 1698 nt, Artificial Sequence
  derived and/or modified sequence opt4 from hemagglutinin__InfluenzaA__ABR15896
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggaggcccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154199 - RNA, 1698 nt, Artificial Sequence; identical to SEQ ID NO: 153261
  derived and/or modified sequence opt4 from hemagglutinin__InfluenzaA__ABR15907

SEQ ID NO: 154200 - RNA, 1698 nt, Artificial Sequence; identical to SEQ ID NO: 153262
  derived and/or modified sequence opt4 from hemagglutinin__InfluenzaA__ABR15918

SEQ ID NO: 154201 - RNA, 1701 nt, Artificial Sequence
  derived and/or modified sequence opt4 from hemagglutinin__InfluenzaA__ABR15929
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcaacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 154202 - RNA, 1701 nt, Artificial Sequence
  derived and/or modified sequence opt4 from hemagglutinin__InfluenzaA__ABR15940
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcaucagcaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcaucgugcugcugggcuucaucaugugggccugccagaagggcaacaucagaugcaacaucugcaucuga

SEQ ID NO: 154203 - RNA, 1701 nt, Artificial Sequence; identical to SEQ ID NO: 153082
  derived and/or modified sequence opt4 from hemagglutinin__InfluenzaA__ABR15951

SEQ ID NO: 154204 - RNA, 1701 nt, Artificial Sequence
  derived and/or modified sequence opt4 from hemagglutinin__InfluenzaA__ABR15962
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcagagccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 154205 - RNA, 1701 nt, Artificial Sequence
  derived and/or modified sequence opt4 from hemagglutinin__InfluenzaA__ABR22241
augaagaccaucaucgcccugagcuacauccugugccuggccuucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcuggaguacagauaccccgcccugaacgugaccaugcccaacaacgacaaguucgacaagcuguacaucuggggcgugcaccaccccagcaccgacagcgaccagaucagcguguacgcccaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacaagcugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagaacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154206 - RNA, 1701 nt, Artificial Sequence; identical to SEQ ID NO: 153170
  derived and/or modified sequence opt4 from hemagglutinin__InfluenzaA__ABR28515

SEQ ID NO: 154207 - RNA, 1701 nt, Artificial Sequence
  derived and/or modified sequence opt4 from hemagglutinin__InfluenzaA__ABR28592
augaagaccaucaucgcccugagcuacguguucugccugguguucgcccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcagcgccugcaagagaggccccgacaacggcuucuucagcagacugaacuggcuguacaagagcggcagcaccuaccccgugcagaacgugaccaugcccaacaacgacaacagcgacaagcuguacaucuggggcgugcaccaccccagcaccgacaaggagcagaccgaccuguacgugcaggccagcggcaaggugaccgugagcaccaagagaagccagcagaccgugauccccaacgugggcagcagacccugggugagaggccugagcagcagagugagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154208 - RNA, 1698 nt, Artificial Sequence; identical to SEQ ID NO: 153262
  derived and/or modified sequence opt4 from hemagglutinin__InfluenzaA__ABR28768

SEQ ID NO: 154209 - RNA, 1698 nt, Artificial Sequence; identical to SEQ ID NO: 153262
  derived and/or modified sequence opt4 from hemagglutinin__InfluenzaA__ABR28779

SEQ ID NO: 154210 - RNA, 1701 nt, Artificial Sequence; identical to SEQ ID NO: 153953
  derived and/or modified sequence opt4 from hemagglutinin__InfluenzaA__ABR28790

SEQ ID NO: 154211 - RNA, 1698 nt, Artificial Sequence; identical to SEQ ID NO: 153262
  derived and/or modified sequence opt4 from hemagglutinin__InfluenzaA__ABR28801

SEQ ID NO: 154212 - RNA, 1701 nt, Artificial Sequence; identical to SEQ ID NO: 153170
  derived and/or modified sequence opt4 from hemagglutinin__InfluenzaA__ABR28812

SEQ ID NO: 154213 - RNA, 1701 nt, Artificial Sequence
  derived and/or modified sequence opt4 from hemagglutinin__InfluenzaA__ABR28823
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 154214 - RNA, 1698 nt, Artificial Sequence; identical to SEQ ID NO: 153390
  derived and/or modified sequence opt4 from hemagglutinin__InfluenzaA__ABR28834

SEQ ID NO: 154215 - RNA, 1698 nt, Artificial Sequence; identical to SEQ ID NO: 153361
  derived and/or modified sequence opt4 from hemagglutinin__InfluenzaA__ABR28845

SEQ ID NO: 154216 - RNA, 1701 nt, Artificial Sequence
  derived and/or modified sequence opt4 from hemagglutinin__InfluenzaA__ABR28856
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaucaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaagacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 154217 - RNA, 1701 nt, Artificial Sequence; identical to SEQ ID NO: 153127
  derived and/or modified sequence opt4 from hemagglutinin__InfluenzaA__ABR28867

SEQ ID NO: 154218 - RNA, 1701 nt, Artificial Sequence; identical to SEQ ID NO: 153082
  derived and/or modified sequence opt4 from hemagglutinin__InfluenzaA__ABR28878

SEQ ID NO: 154219 - RNA, 1698 nt, Artificial Sequence; identical to SEQ ID NO: 153724
  derived and/or modified sequence opt4 from hemagglutinin__InfluenzaA__ABR28900

SEQ ID NO: 154220 - RNA, 1701 nt, Artificial Sequence
  derived and/or modified sequence opt4 from hemagglutinin__InfluenzaA__ABR28922
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154221 - RNA, 1701 nt, Artificial Sequence; identical to SEQ ID NO: 154101
  derived and/or modified sequence opt4 from hemagglutinin__InfluenzaA__ABR88080

SEQ ID NO: 154222 - RNA, 1701 nt, Artificial Sequence
  derived and/or modified sequence opt4 from hemagglutinin__InfluenzaA__ABS00315
augaaggccaagcugcuggugcugcugugcgccuucaccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcguggccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugagcgccagcugcagccacaagggcagaagcagcuucuacagaaaccugcuguggcugaccgagaagaacggcagcuaccccaaccugagcaagagcuacgugaacaacaaggagagagaggugcuggugcuguggggcgugcaccaccccagcaacaucggcgagcagagagccaucuaccacaccgagaacgccuacgugagcguggugagcagccacuacaacagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154223 - RNA, 1701 nt, Artificial Sequence
  derived and/or modified sequence opt4 from hemagglutinin__InfluenzaA__ABS00326
augaaggccaagcugcuggugcugcugugcgccuucaccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcguggccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugagcgccagcugcagccacaagggcagaagcagcuucuacagaaaccugcuguggcugaccgagaagaacggcagcuaccccaaccugagcaagagcuacgugaacaacaaggagaaggaggugcuggugcuguggggcgugcaccaccccagcaacaucggcgagcagagagccaucuaccacaccgagaacgccuacgugagcguggugagcagccacuacaacagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154224 - RNA, 1701 nt, Artificial Sequence; identical to SEQ ID NO: 154160
  derived and/or modified sequence opt4 from hemagglutinin__InfluenzaA__ABS49899

SEQ ID NO: 154225 - RNA, 1701 nt, Artificial Sequence
  derived and/or modified sequence opt4 from hemagglutinin__InfluenzaA__ABS49910
augaagaccaucaucgcccugagcuacaucuucugccuggcccugggccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucaacugcacccugaucgacgcccugcugggcgacccccacugcgacguguuccaggacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagaugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154226 - RNA, 1701 nt, Artificial Sequence; identical to SEQ ID NO: 153170
  derived and/or modified sequence opt4 from hemagglutinin__InfluenzaA__ABS49965

SEQ ID NO: 154227 - RNA, 1698 nt, Artificial Sequence
  derived and/or modified sequence opt4 from hemagglutinin__InfluenzaA__ABS49976
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacaacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154228 - RNA, 1698 nt, Artificial Sequence
  derived and/or modified sequence opt4 from hemagglutinin__InfluenzaA__ABS49987
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacaugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154229 - RNA, 1701 nt, Artificial Sequence
  derived and/or modified sequence opt4 from hemagglutinin__InfluenzaA__ABS49998
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaucaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154230 - RNA, 1701 nt, Artificial Sequence
  derived and/or modified sequence opt4 from hemagglutinin__InfluenzaA__ABS50009
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcaagaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154231 - RNA, 1701 nt, Artificial Sequence; identical to SEQ ID NO: 153230
  derived and/or modified sequence opt4 from hemagglutinin__InfluenzaA__ABS50020

SEQ ID NO: 154232 - RNA, 1701 nt, Artificial Sequence
  derived and/or modified sequence opt4 from hemagglutinin__InfluenzaA__ABS50031
augaagaccaucaucgcccugagcuacaugcugugccugguguucgcccagaagcugcccggcaacgacaacagcaccgccaugcugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcggccccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154233 - RNA, 1701 nt, Artificial Sequence; identical to SEQ ID NO: 152571
  derived and/or modified sequence opt4 from hemagglutinin__InfluenzaA__ABS50042

SEQ ID NO: 154234 - RNA, 1701 nt, Artificial Sequence; identical to SEQ ID NO: 154213
  derived and/or modified sequence opt4 from hemagglutinin__InfluenzaA__ABS50053

SEQ ID NO: 154235 - RNA, 1701 nt, Artificial Sequence
  derived and/or modified sequence opt4 from hemagglutinin__InfluenzaA__ABS50064
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaccacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcuggugagccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 154236 - RNA, 1701 nt, Artificial Sequence
  derived and/or modified sequence opt4 from hemagglutinin__InfluenzaA__ABS50075
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccacaagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154237 - RNA, 1698 nt, Artificial Sequence
  derived and/or modified sequence opt4 from hemagglutinin__InfluenzaA__ABS71665
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcagagagagcuggagcuacaucguggagaagcccagccccgagaacggcaccugcuaccccggccacuucgccgacuacgaggagcugagagagcagcugagcagcgugagcagcuucgagagauucgagaucuuccccaaggagagcagcuggcccaaccacaccgccaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaaaguucacccccgagaucgccaagagacccaaggugagagaccaggagggcagaaucagcuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154238 - RNA, 1698 nt, Artificial Sequence
  derived and/or modified sequence opt4 from hemagglutinin__InfluenzaA__ABS71666
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcagagagagcuggagcuacaucguggagaagcccagccccgagaacggcaccugcuaccccggccacuucgccgacuacgaggagcugagagagcagcugagcagcgugagcagcuucgagagauucgagaucuuccccaaggagagcagcuggcccaaccacaccgccaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaaaguucacccccgagaucgccaagagacccaaggugagagaccaggagggcagaaucagcuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154239 - RNA, 1698 nt, Artificial Sequence
  derived and/or modified sequence opt4 from hemagglutinin__InfluenzaA__ABS71667
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcagagagagcuggagcuacaucguggagaagcccagccccgagaacggcaccugcuaccccggccacuucgccgacuacgaggagcugagagagcagcugagcagcgugagcagcuucgagagauucgagaucuuccccaaggagagcagcuggcccaaccacaccgccaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacaucagcguggugagcagccacuacagcagaaaguucacccccgagaucgccaagagacccaaggugagagaccaggagggcagaaucagcuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154240 - RNA, 1698 nt, Artificial Sequence
  derived and/or modified sequence opt4 from hemagglutinin__InfluenzaA__ABS71668
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcagagagagcuggagcuacaucguggagaagcccagccccgagaacggcaccugcuaccccggccacuucgccgacuacgaggagcugagagagcagcugagcagcgugagcagcuucgagagauucgagaucuuccccaaggagagcagcuggcccaaccacaccgccagcggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154241 - RNA, 1698 nt, Artificial Sequence
  derived and/or modified sequence opt4 from hemagglutinin__InfluenzaA__ABS71669
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154242 - RNA, 1698 nt, Artificial Sequence
  derived and/or modified sequence opt4 from hemagglutinin__InfluenzaA__ABS71671
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagauguuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154243 - RNA, 1698 nt, Artificial Sequence
  derived and/or modified sequence opt4 from hemagglutinin__InfluenzaA__ABS71672
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagagacugagcagcgugagcagcuucgagagauucgagauguuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgcccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154244 - RNA, 1698 nt, Artificial Sequence
  derived and/or modified sequence opt4 from hemagglutinin__InfluenzaA__ABS71673
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcagaagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacaccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154245 - RNA, 1701 nt, Artificial Sequence; identical to SEQ ID NO: 153150
  derived and/or modified sequence opt4 from hemagglutinin__InfluenzaA__ABS71674

SEQ ID NO: 154246 - RNA, 1701 nt, Artificial Sequence
  derived and/or modified sequence opt4 from hemagglutinin__InfluenzaA__ABS71675
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154247 - RNA, 1701 nt, Artificial Sequence
  derived and/or modified sequence opt4 from hemagglutinin__InfluenzaA__ABS71676
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaucaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154248 - RNA, 1701 nt, Artificial Sequence
  derived and/or modified sequence opt4 from hemagglutinin__InfluenzaA__ABS71677
augaagaccaucaucgcccugagcuacauccugugccugguguucgcccagaagcugcccggcaucgacaacagcaccgccacccugugccugggccaccacgccgugcccaacggcaccaucgugaagaccaucaccgacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154249 - RNA, 1701 nt, Artificial Sequence
  derived and/or modified sequence opt4 from hemagglutinin__InfluenzaA__ABS71679
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154250 - RNA, 1701 nt, Artificial Sequence; identical to SEQ ID NO: 154249
  derived and/or modified sequence opt4 from hemagglutinin__InfluenzaA__ABS71680

SEQ ID NO: 154251 - RNA, 1701 nt, Artificial Sequence
  derived and/or modified sequence opt4 from hemagglutinin__InfluenzaA__ABS71682
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154252 - RNA, 1701 nt, Artificial Sequence
  derived and/or modified sequence opt4 from hemagglutinin__InfluenzaA__ABU80177
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcagcugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154253 - RNA, 1698 nt, Artificial Sequence
  derived and/or modified sequence opt4 from hemagglutinin__InfluenzaA__ABU80298
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacaagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154254 - RNA, 1701 nt, Artificial Sequence
  derived and/or modified sequence opt4 from hemagglutinin__InfluenzaA__ABU80320
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacagcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcaucaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154255 - RNA, 1701 nt, Artificial Sequence; identical to SEQ ID NO: 153559
  derived and/or modified sequence opt4 from hemagglutinin__InfluenzaA__ABU80331

SEQ ID NO: 154256 - RNA, 1701 nt, Artificial Sequence
  derived and/or modified sequence opt4 from hemagglutinin__InfluenzaA__ABU80400
augaaggccauccugcuggugcugcuguacaccuucaccgccgccaacgccgacacccugugcaucggcuaccacgccaacaacagcaccgacaccguggacaccgugcuggagaagaacgugaccgugacccacagcgugaaccugcuggaggacagacacaacggcaagcugugcaagcugagaggcguggccccccugcaccugggcaagugcaacaucgccggcuggcugcugggcaaccccgagugcgagcugcuguucaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaaggccagcagcuggcccaaccacgagaccaacagaggcgugaccgccgccugccccuacgccggcgccaacagcuucuacagaaaccugaucuggcuggugaagaagggcaacagcuaccccaagcugagcaagagcuacgugaacaacaaggagaaggaggugcuggugcuguggggcauccaccacccccccaccagcaccgaccagcagagccuguaccagaacgccgacgccuacguguucgugggcagcagcaaguacaacaagaaguucaagcccgagaucgccaccagacccaaggugagaggccaggccggcagaaugaacuacuacuggacccugguggagcccggcgacaccaucaccuucgaggccaccggcaaccugguggugcccagauacgccuucgccaugaagagaggcagcggcagcggcaucaucaucagcgacacccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacagaaagagcacccagaacgccaucgacggcaucaccaacaaggugaacagcgugaucgagaagaugaacacccaguucaccgccgugggcaaggaguucaaccaccuggagaagagaaucgagaaccugaacagaaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaccugcauggagagcgugaagaacggcaccuacgacuaccccaaguacagcgaggagagcaagcugaacagagaggagaucgacggcgugaagcuggagagcaccagaaucuaccagauccuggccaucuacagcaccguggccagcagccuggugcugcuggugagccugggcgccaucagcuucuggaugugcagcaacggcagccugcagugcagaaucugcaucuga

SEQ ID NO: 154257 - RNA, 1701 nt, Artificial Sequence
  derived and/or modified sequence opt4 from hemagglutinin__InfluenzaA__ABU92572
augaagaccaucaucgcccugagcuacauccugugccugguguucacccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 154258 - RNA, 1701 nt, Artificial Sequence
  derived and/or modified sequence opt4 from hemagglutinin__InfluenzaA__ABU92573
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacggcaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucaagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 154259 - RNA, 1701 nt, Artificial Sequence
  derived and/or modified sequence opt4 from hemagglutinin__InfluenzaA__ABU92575
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcaagcccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 154260 - RNA, 1701 nt, Artificial Sequence; identical to SEQ ID NO: 152571
  derived and/or modified sequence opt4 from hemagglutinin__InfluenzaA__ABU92576

SEQ ID NO: 154261 - RNA, 1701 nt, Artificial Sequence; identical to SEQ ID NO: 152571
  derived and/or modified sequence opt4 from hemagglutinin__InfluenzaA__ABU92577

SEQ ID NO: 154262 - RNA, 1701 nt, Artificial Sequence; identical to SEQ ID NO: 152592
  derived and/or modified sequence opt4 from hemagglutinin__InfluenzaA__ABU92578

SEQ ID NO: 154263 - RNA, 1701 nt, Artificial Sequence; identical to SEQ ID NO: 152592
  derived and/or modified sequence opt4 from hemagglutinin__InfluenzaA__ABU92579

SEQ ID NO: 154264 - RNA, 1701 nt, Artificial Sequence; identical to SEQ ID NO: 152592
  derived and/or modified sequence opt4 from hemagglutinin__InfluenzaA__ABU92580

SEQ ID NO: 154265 - RNA, 1701 nt, Artificial Sequence; identical to SEQ ID NO: 154257
  derived and/or modified sequence opt4 from hemagglutinin__InfluenzaA__ABU92581

SEQ ID NO: 154266 - RNA, 1701 nt, Artificial Sequence
  derived and/or modified sequence opt4 from hemagglutinin__InfluenzaA__ABU92582
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccagaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 154267 - RNA, 1701 nt, Artificial Sequence; identical to SEQ ID NO: 154266
  derived and/or modified sequence opt4 from hemagglutinin__InfluenzaA__ABU92583

SEQ ID NO: 154268 - RNA, 1701 nt, Artificial Sequence
  derived and/or modified sequence opt4 from hemagglutinin__InfluenzaA__ABU92584
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugagauacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaagacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 154269 - RNA, 1701 nt, Artificial Sequence
  derived and/or modified sequence opt4 from hemagglutinin__InfluenzaA__ABU92586
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaagaacuggauccuguggaucagcuucgccaucagcugcuuccugcugugcguggcccugcugggcuucaucaugugggccugccagaagggcaacaucagaugcaacaucugcaucuga

SEQ ID NO: 154270 - RNA, 1701 nt, Artificial Sequence
  derived and/or modified sequence opt4 from hemagglutinin__InfluenzaA__ABU92587
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgccauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154271 - RNA, 1701 nt, Artificial Sequence
  derived and/or modified sequence opt4 from hemagglutinin__InfluenzaA__ABU92588
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaaagagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgaguuccugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154272 - RNA, 1701 nt, Artificial Sequence; identical to SEQ ID NO: 153153
  derived and/or modified sequence opt4 from hemagglutinin__InfluenzaA__ABU92590

SEQ ID NO: 154273 - RNA, 1701 nt, Artificial Sequence
  derived and/or modified sequence opt4 from hemagglutinin__InfluenzaA__ABU92591
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154274 - RNA, 1701 nt, Artificial Sequence; identical to SEQ ID NO: 154273
  derived and/or modified sequence opt4 from hemagglutinin__InfluenzaA__ABU92592

SEQ ID NO: 154275 - RNA, 1701 nt, Artificial Sequence
  derived and/or modified sequence opt4 from hemagglutinin__InfluenzaA__ABU92593
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccggccagaagggcaacaagagaugcaacaucugcaucuga

SEQ ID NO: 154276 - RNA, 1701 nt, Artificial Sequence
  derived and/or modified sequence opt4 from hemagglutinin__InfluenzaA__ABU92594
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagagcugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugagcggcuucaucaugugggccugccagaagggcaacaucagaugcaacaucugcaucuga

SEQ ID NO: 154277 - RNA, 1701 nt, Artificial Sequence
  derived and/or modified sequence opt4 from hemagglutinin__InfluenzaA__ABU92595
augaagaccaucaucgcccugagcuacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154278 - RNA, 1701 nt, Artificial Sequence
  derived and/or modified sequence opt4 from hemagglutinin__InfluenzaA__ABU92596
augaagaccaucaucgcccugagcuacauccugugccugguguucgcccagaagcugcccggcaacgacaacagcaccgccacccugugccugggccaccacgccgugcccaacggcaccauggugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcgacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcggcugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154279 - RNA, 1701 nt, Artificial Sequence; identical to SEQ ID NO: 153150
  derived and/or modified sequence opt4 from hemagglutinin__InfluenzaA__ABU92597

SEQ ID NO: 154280 - RNA, 1701 nt, Artificial Sequence; identical to SEQ ID NO: 152593
  derived and/or modified sequence opt4 from hemagglutinin__InfluenzaA__ABU92601

SEQ ID NO: 154281 - RNA, 1701 nt, Artificial Sequence; identical to SEQ ID NO: 152593
  derived and/or modified sequence opt4 from hemagglutinin__InfluenzaA__ABU92602

SEQ ID NO: 154282 - RNA, 1701 nt, Artificial Sequence
  derived and/or modified sequence opt4 from hemagglutinin__InfluenzaA__ABU92603
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcgacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154283 - RNA, 1701 nt, Artificial Sequence; identical to SEQ ID NO: 152593
  derived and/or modified sequence opt4 from hemagglutinin__InfluenzaA__ABU92604

SEQ ID NO: 154284 - RNA, 1701 nt, Artificial Sequence; identical to SEQ ID NO: 154282
  derived and/or modified sequence opt4 from hemagglutinin__InfluenzaA__ABU92605

SEQ ID NO: 154285 - RNA, 1701 nt, Artificial Sequence; identical to SEQ ID NO: 154282
  derived and/or modified sequence opt4 from hemagglutinin__InfluenzaA__ABU92606

SEQ ID NO: 154286 - RNA, 1701 nt, Artificial Sequence; identical to SEQ ID NO: 153132
  derived and/or modified sequence opt4 from hemagglutinin__InfluenzaA__ABU92608

SEQ ID NO: 154287 - RNA, 1701 nt, Artificial Sequence; identical to SEQ ID NO: 153132
  derived and/or modified sequence opt4 from hemagglutinin__InfluenzaA__ABU92609

SEQ ID NO: 154288 - RNA, 1701 nt, Artificial Sequence
  derived and/or modified sequence opt4 from hemagglutinin__InfluenzaA__ABU92610
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccacagcaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucgccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugagcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154289 - RNA, 1701 nt, Artificial Sequence
  derived and/or modified sequence opt4 from hemagglutinin__InfluenzaA__ABU92611
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucagccuguacgcccaggccagcggcaagaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaucugggccugccugaagggcaacaucagaugcaacaucugcaucuga

SEQ ID NO: 154290 - RNA, 1701 nt, Artificial Sequence
  derived and/or modified sequence opt4 from hemagglutinin__InfluenzaA__ABU92612
augaagaccaucaucgcccugagcuacauccugugccugguguucgcccagaagcugcccggcaacgacaacagcaccgccacccugugccugggccaccacgccgugcccaacggcaccauggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacaacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154291 - RNA, 1701 nt, Artificial Sequence; identical to SEQ ID NO: 153778
  derived and/or modified sequence opt4 from hemagglutinin__InfluenzaA__ABU92613

SEQ ID NO: 154292 - RNA, 1701 nt, Artificial Sequence; identical to SEQ ID NO: 154277
  derived and/or modified sequence opt4 from hemagglutinin__InfluenzaA__ABU92614

SEQ ID NO: 154293 - RNA, 1701 nt, Artificial Sequence
  derived and/or modified sequence opt4 from hemagglutinin__InfluenzaA__ABU92615
augaagaccaucaucgcccugagcuacauccugugccugguguucgcccagaagcugcccggcaacgacaacagcaccgccacccugugccugggccaccacgccgugcccaacggcaccaucgugagaaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacgugggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154294 - RNA, 1701 nt, Artificial Sequence
  derived and/or modified sequence opt4 from hemagglutinin__InfluenzaA__ABU92617
augaagaccaucaucgcccugagcuacauccugugccugguguucgcccagaagcugcccggcaacgacaacagcaccgccacccugugccugggccaccacagcgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154295 - RNA, 1701 nt, Artificial Sequence; identical to SEQ ID NO: 153778
  derived and/or modified sequence opt4 from hemagglutinin__InfluenzaA__ABU92619

SEQ ID NO: 154296 - RNA, 1701 nt, Artificial Sequence; identical to SEQ ID NO: 154277
  derived and/or modified sequence opt4 from hemagglutinin__InfluenzaA__ABU92620

SEQ ID NO: 154297 - RNA, 1701 nt, Artificial Sequence
  derived and/or modified sequence opt4 from hemagglutinin__InfluenzaA__ABU92622
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagaagcgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154298 - RNA, 1701 nt, Artificial Sequence; identical to SEQ ID NO: 152593
  derived and/or modified sequence opt4 from hemagglutinin__InfluenzaA__ABU92623

SEQ ID NO: 154299 - RNA, 1701 nt, Artificial Sequence
  derived and/or modified sequence opt4 from hemagglutinin__InfluenzaA__ABU92624
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcgacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggcccugggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154300 - RNA, 1701 nt, Artificial Sequence; identical to SEQ ID NO: 154282
  derived and/or modified sequence opt4 from hemagglutinin__InfluenzaA__ABU92625

SEQ ID NO: 154301 - RNA, 1701 nt, Artificial Sequence; identical to SEQ ID NO: 152593
  derived and/or modified sequence opt4 from hemagglutinin__InfluenzaA__ABU92626

SEQ ID NO: 154302 - RNA, 1701 nt, Artificial Sequence
  derived and/or modified sequence opt4 from hemagglutinin__InfluenzaA__ABU92627
augaagaccaucaucgcccugagcuacauccugugcaugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcgacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagacccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154303 - RNA, 1701 nt, Artificial Sequence; identical to SEQ ID NO: 154282
  derived and/or modified sequence opt4 from hemagglutinin__InfluenzaA__ABU92628

SEQ ID NO: 154304 - RNA, 1701 nt, Artificial Sequence; identical to SEQ ID NO: 154282
  derived and/or modified sequence opt4 from hemagglutinin__InfluenzaA__ABU92631

SEQ ID NO: 154305 - RNA, 1701 nt, Artificial Sequence
  derived and/or modified sequence opt4 from hemagglutinin__InfluenzaA__ABU92632
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccugaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154306 - RNA, 1701 nt, Artificial Sequence
  derived and/or modified sequence opt4 from hemagglutinin__InfluenzaA__ABU92635
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagcaucguggccagcagcggcacccuggaguucaacaacgagagcuucaacuggaccggcgugacccagaacggcaccagcagcgccugcaagagaaagagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154307 - RNA, 1701 nt, Artificial Sequence; identical to SEQ ID NO: 153150
  derived and/or modified sequence opt4 from hemagglutinin__InfluenzaA__ABU92636

SEQ ID NO: 154308 - RNA, 1701 nt, Artificial Sequence
  derived and/or modified sequence opt4 from hemagglutinin__InfluenzaA__ABU92637
augaagaccaucaucgcccugagcuacauccugugccugguguucgcccagaagcugcccggcaacgacaacagcaccgccacccugugccugggccaccacgccgugcccaacggcaccaccgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgugagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154309 - RNA, 1701 nt, Artificial Sequence
  derived and/or modified sequence opt4 from hemagglutinin__InfluenzaA__ABU92639
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcgacagcccccaccagauccuggacggcgagaacugcacccugaucgacgcccugcugggcgacccccagugcgacggcuuccagaacaccaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcgacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacaucgaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154310 - RNA, 1701 nt, Artificial Sequence
  derived and/or modified sequence opt4 from hemagglutinin__InfluenzaA__ABU92640
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcgccgcccugcugggcuucaucaugugggccugccagaagggcaacaucagaugcaacaucugcaucuga

SEQ ID NO: 154311 - RNA, 1701 nt, Artificial Sequence
  derived and/or modified sequence opt4 from hemagglutinin__InfluenzaA__ABU92641
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaaagagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154312 - RNA, 1701 nt, Artificial Sequence
  derived and/or modified sequence opt4 from hemagglutinin__InfluenzaA__ABU92642
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaucgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154313 - RNA, 1701 nt, Artificial Sequence
  derived and/or modified sequence opt4 from hemagglutinin__InfluenzaA__ABU92643
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcgacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154314 - RNA, 1701 nt, Artificial Sequence
  derived and/or modified sequence opt4 from hemagglutinin__InfluenzaA__ABU92645
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucgccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcaucgagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154315 - RNA, 1701 nt, Artificial Sequence
  derived and/or modified sequence opt4 from hemagglutinin__InfluenzaA__ABU92646
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154316 - RNA, 1701 nt, Artificial Sequence; identical to SEQ ID NO: 152593
  derived and/or modified sequence opt4 from hemagglutinin__InfluenzaA__ABU92647

SEQ ID NO: 154317 - RNA, 1701 nt, Artificial Sequence
  derived and/or modified sequence opt4 from hemagglutinin__InfluenzaA__ABU92648
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcgacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154318 - RNA, 1701 nt, Artificial Sequence; identical to SEQ ID NO: 152593
  derived and/or modified sequence opt4 from hemagglutinin__InfluenzaA__ABU92649

SEQ ID NO: 154319 - RNA, 1701 nt, Artificial Sequence; identical to SEQ ID NO: 154282
  derived and/or modified sequence opt4 from hemagglutinin__InfluenzaA__ABU92650

SEQ ID NO: 154320 - RNA, 1701 nt, Artificial Sequence
  derived and/or modified sequence opt4 from hemagglutinin__InfluenzaA__ABU92651
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucuacaacgagagcuucgacuggaccggcgugacccagaacggcaccagcagcgccugcaagagaagaagcgacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154321 - RNA, 1701 nt, Artificial Sequence
  derived and/or modified sequence opt4 from hemagglutinin__InfluenzaA__ABU92652
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaucggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154322 - RNA, 1701 nt, Artificial Sequence; identical to SEQ ID NO: 154282
  derived and/or modified sequence opt4 from hemagglutinin__InfluenzaA__ABU92653

SEQ ID NO: 154323 - RNA, 1701 nt, Artificial Sequence
  derived and/or modified sequence opt4 from hemagglutinin__InfluenzaA__ABU92654
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcaagaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccugaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacgccgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154324 - RNA, 1701 nt, Artificial Sequence
  derived and/or modified sequence opt4 from hemagglutinin__InfluenzaA__ABU92655
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacgccgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154325 - RNA, 1701 nt, Artificial Sequence; identical to SEQ ID NO: 154282
  derived and/or modified sequence opt4 from hemagglutinin__InfluenzaA__ABU92656

SEQ ID NO: 154326 - RNA, 1701 nt, Artificial Sequence; identical to SEQ ID NO: 153153
  derived and/or modified sequence opt4 from hemagglutinin__InfluenzaA__ABU92657

SEQ ID NO: 154327 - RNA, 1701 nt, Artificial Sequence; identical to SEQ ID NO: 154282
  derived and/or modified sequence opt4 from hemagglutinin__InfluenzaA__ABU92658

SEQ ID NO: 154328 - RNA, 1701 nt, Artificial Sequence; identical to SEQ ID NO: 153153
  derived and/or modified sequence opt4 from hemagglutinin__InfluenzaA__ABU92659

SEQ ID NO: 154329 - RNA, 1701 nt, Artificial Sequence; identical to SEQ ID NO: 154282
  derived and/or modified sequence opt4 from hemagglutinin__InfluenzaA__ABU92660

SEQ ID NO: 154330 - RNA, 1701 nt, Artificial Sequence
  derived and/or modified sequence opt4 from hemagglutinin__InfluenzaA__ABU92661
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcgacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcuggagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154331 - RNA, 1701 nt, Artificial Sequence; identical to SEQ ID NO: 152593
  derived and/or modified sequence opt4 from hemagglutinin__InfluenzaA__ABU92662

SEQ ID NO: 154332 - RNA, 1701 nt, Artificial Sequence; identical to SEQ ID NO: 154282
  derived and/or modified sequence opt4 from hemagglutinin__InfluenzaA__ABU92663

SEQ ID NO: 154333 - RNA, 1701 nt, Artificial Sequence; identical to SEQ ID NO: 154282
  derived and/or modified sequence opt4 from hemagglutinin__InfluenzaA__ABU92664

SEQ ID NO: 154334 - RNA, 1701 nt, Artificial Sequence
  derived and/or modified sequence opt4 from hemagglutinin__InfluenzaA__ABU92665
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugacccagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154335 - RNA, 1701 nt, Artificial Sequence; identical to SEQ ID NO: 154282
  derived and/or modified sequence opt4 from hemagglutinin__InfluenzaA__ABU92666

SEQ ID NO: 154336 - RNA, 1701 nt, Artificial Sequence; identical to SEQ ID NO: 152592
  derived and/or modified sequence opt4 from hemagglutinin__InfluenzaA__ABU92667

SEQ ID NO: 154337 - RNA, 1701 nt, Artificial Sequence; identical to SEQ ID NO: 152592
  derived and/or modified sequence opt4 from hemagglutinin__InfluenzaA__ABU92668

SEQ ID NO: 154338 - RNA, 1701 nt, Artificial Sequence
  derived and/or modified sequence opt4 from hemagglutinin__InfluenzaA__ABU92669
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaaacggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154339 - RNA, 1701 nt, Artificial Sequence; identical to SEQ ID NO: 152592
  derived and/or modified sequence opt4 from hemagglutinin__InfluenzaA__ABU92670

SEQ ID NO: 154340 - RNA, 1701 nt, Artificial Sequence
  derived and/or modified sequence opt4 from hemagglutinin__InfluenzaA__ABU92671
augaagaccaucaucgcccugagccacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacaucccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgaggccgagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154341 - RNA, 1701 nt, Artificial Sequence; identical to SEQ ID NO: 152592
  derived and/or modified sequence opt4 from hemagglutinin__InfluenzaA__ABU92672

SEQ ID NO: 154342 - RNA, 1701 nt, Artificial Sequence; identical to SEQ ID NO: 152592
  derived and/or modified sequence opt4 from hemagglutinin__InfluenzaA__ABU92673

SEQ ID NO: 154343 - RNA, 1701 nt, Artificial Sequence
  derived and/or modified sequence opt4 from hemagglutinin__InfluenzaA__ABU92674
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagaaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154344 - RNA, 1701 nt, Artificial Sequence
  derived and/or modified sequence opt4 from hemagglutinin__InfluenzaA__ABU92675
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaugggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154345 - RNA, 1701 nt, Artificial Sequence; identical to SEQ ID NO: 153153
  derived and/or modified sequence opt4 from hemagglutinin__InfluenzaA__ABU92676

SEQ ID NO: 154346 - RNA, 1701 nt, Artificial Sequence; identical to SEQ ID NO: 154273
  derived and/or modified sequence opt4 from hemagglutinin__InfluenzaA__ABU92677

SEQ ID NO: 154347 - RNA, 1701 nt, Artificial Sequence
  derived and/or modified sequence opt4 from hemagglutinin__InfluenzaA__ABU92678
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggccugcagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154348 - RNA, 1701 nt, Artificial Sequence
  derived and/or modified sequence opt4 from hemagglutinin__InfluenzaA__ABU92680
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154349 - RNA, 1701 nt, Artificial Sequence; identical to SEQ ID NO: 154277
  derived and/or modified sequence opt4 from hemagglutinin__InfluenzaA__ABU92681

SEQ ID NO: 154350 - RNA, 1701 nt, Artificial Sequence; identical to SEQ ID NO: 152593
  derived and/or modified sequence opt4 from hemagglutinin__InfluenzaA__ABU92682

SEQ ID NO: 154351 - RNA, 1701 nt, Artificial Sequence; identical to SEQ ID NO: 154282
  derived and/or modified sequence opt4 from hemagglutinin__InfluenzaA__ABU92683

SEQ ID NO: 154352 - RNA, 1701 nt, Artificial Sequence
  derived and/or modified sequence opt4 from hemagglutinin__InfluenzaA__ABU92684
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggcccccggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154353 - RNA, 1701 nt, Artificial Sequence
  derived and/or modified sequence opt4 from hemagglutinin__InfluenzaA__ABU92685
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugaagagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154354 - RNA, 1701 nt, Artificial Sequence; identical to SEQ ID NO: 154282
  derived and/or modified sequence opt4 from hemagglutinin__InfluenzaA__ABU92686

SEQ ID NO: 154355 - RNA, 1701 nt, Artificial Sequence; identical to SEQ ID NO: 154282
  derived and/or modified sequence opt4 from hemagglutinin__InfluenzaA__ABU92687

SEQ ID NO: 154356 - RNA, 1701 nt, Artificial Sequence; identical to SEQ ID NO: 154315
  derived and/or modified sequence opt4 from hemagglutinin__InfluenzaA__ABU92688

SEQ ID NO: 154357 - RNA, 1701 nt, Artificial Sequence; identical to SEQ ID NO: 154282
  derived and/or modified sequence opt4 from hemagglutinin__InfluenzaA__ABU92689

SEQ ID NO: 154358 - RNA, 1701 nt, Artificial Sequence
  derived and/or modified sequence opt4 from hemagglutinin__InfluenzaA__ABU92691
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcgugaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaucggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154359 - RNA, 1701 nt, Artificial Sequence; identical to SEQ ID NO: 153210
  derived and/or modified sequence opt4 from hemagglutinin__InfluenzaA__ABU92692

SEQ ID NO: 154360 - RNA, 1701 nt, Artificial Sequence
  derived and/or modified sequence opt4 from hemagglutinin__InfluenzaA__ABU92693
augaaggccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcgacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154361 - RNA, 1701 nt, Artificial Sequence
  derived and/or modified sequence opt4 from hemagglutinin__InfluenzaA__ABU92694
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagguggaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154362 - RNA, 1701 nt, Artificial Sequence; identical to SEQ ID NO: 154273
  derived and/or modified sequence opt4 from hemagglutinin__InfluenzaA__ABU92695

SEQ ID NO: 154363 - RNA, 1701 nt, Artificial Sequence
  derived and/or modified sequence opt4 from hemagglutinin__InfluenzaA__ABU92696
augaagaccaucaucgcccugggcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154364 - RNA, 1701 nt, Artificial Sequence; identical to SEQ ID NO: 153153
  derived and/or modified sequence opt4 from hemagglutinin__InfluenzaA__ABU92697

SEQ ID NO: 154365 - RNA, 1701 nt, Artificial Sequence; identical to SEQ ID NO: 152763
  derived and/or modified sequence opt4 from hemagglutinin__InfluenzaA__ABU92698

SEQ ID NO: 154366 - RNA, 1701 nt, Artificial Sequence
  derived and/or modified sequence opt4 from hemagglutinin__InfluenzaA__ABU92699
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154367 - RNA, 1701 nt, Artificial Sequence
  derived and/or modified sequence opt4 from hemagglutinin__InfluenzaA__ABU92700
augaagaccaucaucgcccugagcuacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagagauucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154368 - RNA, 1701 nt, Artificial Sequence
  derived and/or modified sequence opt4 from hemagglutinin__InfluenzaA__ABU92701
augaagaccaucaucgcccugagcuacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagagauucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagacugcagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154369 - RNA, 1701 nt, Artificial Sequence; identical to SEQ ID NO: 153132
  derived and/or modified sequence opt4 from hemagglutinin__InfluenzaA__ABU92702

SEQ ID NO: 154370 - RNA, 1701 nt, Artificial Sequence; identical to SEQ ID NO: 154348
  derived and/or modified sequence opt4 from hemagglutinin__InfluenzaA__ABU92703

SEQ ID NO: 154371 - RNA, 1701 nt, Artificial Sequence
  derived and/or modified sequence opt4 from hemagglutinin__InfluenzaA__ABU92704
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaaacaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154372 - RNA, 1701 nt, Artificial Sequence
  derived and/or modified sequence opt4 from hemagglutinin__InfluenzaA__ABU92705
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucagccuguacgcccaggcccccggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauucagaaucaagagcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154373 - RNA, 1701 nt, Artificial Sequence; identical to SEQ ID NO: 152593
  derived and/or modified sequence opt4 from hemagglutinin__InfluenzaA__ABU92706

SEQ ID NO: 154374 - RNA, 1701 nt, Artificial Sequence; identical to SEQ ID NO: 154282
  derived and/or modified sequence opt4 from hemagglutinin__InfluenzaA__ABU92707

SEQ ID NO: 154375 - RNA, 1701 nt, Artificial Sequence; identical to SEQ ID NO: 154282
  derived and/or modified sequence opt4 from hemagglutinin__InfluenzaA__ABU92708

SEQ ID NO: 154376 - RNA, 1701 nt, Artificial Sequence
  derived and/or modified sequence opt4 from hemagglutinin__InfluenzaA__ABU92709
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154377 - RNA, 1701 nt, Artificial Sequence; identical to SEQ ID NO: 152571
  derived and/or modified sequence opt4 from hemagglutinin__InfluenzaA__ABU92710

SEQ ID NO: 154378 - RNA, 1701 nt, Artificial Sequence; identical to SEQ ID NO: 152593
  derived and/or modified sequence opt4 from hemagglutinin__InfluenzaA__ABU92711

SEQ ID NO: 154379 - RNA, 1701 nt, Artificial Sequence; identical to SEQ ID NO: 152593
  derived and/or modified sequence opt4 from hemagglutinin__InfluenzaA__ABU92712

SEQ ID NO: 154380 - RNA, 1701 nt, Artificial Sequence; identical to SEQ ID NO: 154282
  derived and/or modified sequence opt4 from hemagglutinin__InfluenzaA__ABU92713

SEQ ID NO: 154381 - RNA, 1701 nt, Artificial Sequence; identical to SEQ ID NO: 154282
  derived and/or modified sequence opt4 from hemagglutinin__InfluenzaA__ABU92714

SEQ ID NO: 154382 - RNA, 1701 nt, Artificial Sequence
  derived and/or modified sequence opt4 from hemagglutinin__InfluenzaA__ABU92715
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgagaagcuguacaucuggggcgugcaccaccccggcaccgacagcgaccagaucaaccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154383 - RNA, 1701 nt, Artificial Sequence; identical to SEQ ID NO: 154282
  derived and/or modified sequence opt4 from hemagglutinin__InfluenzaA__ABU92716

SEQ ID NO: 154384 - RNA, 1701 nt, Artificial Sequence; identical to SEQ ID NO: 154282
  derived and/or modified sequence opt4 from hemagglutinin__InfluenzaA__ABU92717

SEQ ID NO: 154385 - RNA, 1701 nt, Artificial Sequence; identical to SEQ ID NO: 152593
  derived and/or modified sequence opt4 from hemagglutinin__InfluenzaA__ABU92718

SEQ ID NO: 154386 - RNA, 1701 nt, Artificial Sequence; identical to SEQ ID NO: 152593
  derived and/or modified sequence opt4 from hemagglutinin__InfluenzaA__ABU92719

SEQ ID NO: 154387 - RNA, 1701 nt, Artificial Sequence
  derived and/or modified sequence opt4 from hemagglutinin__InfluenzaA__ABU92720
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacagcagccugagaagccugguggccagcagcggcacccuggaguucaacaacgagagcuucgacuggaccggcgugacccagaacggcaccagcagcgccugcaagagaagaagcgacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154388 - RNA, 1701 nt, Artificial Sequence
  derived and/or modified sequence opt4 from hemagglutinin__InfluenzaA__ABU92721
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcgacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugacccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154389 - RNA, 1701 nt, Artificial Sequence; identical to SEQ ID NO: 154273
  derived and/or modified sequence opt4 from hemagglutinin__InfluenzaA__ABU92722

SEQ ID NO: 154390 - RNA, 1701 nt, Artificial Sequence; identical to SEQ ID NO: 152593
  derived and/or modified sequence opt4 from hemagglutinin__InfluenzaA__ABU92723

SEQ ID NO: 154391 - RNA, 1701 nt, Artificial Sequence; identical to SEQ ID NO: 154376
  derived and/or modified sequence opt4 from hemagglutinin__InfluenzaA__ABU92724

SEQ ID NO: 154392 - RNA, 1701 nt, Artificial Sequence
  derived and/or modified sequence opt4 from hemagglutinin__InfluenzaA__ABU92725
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucaaccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgaccugcugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154393 - RNA, 1701 nt, Artificial Sequence; identical to SEQ ID NO: 154376
  derived and/or modified sequence opt4 from hemagglutinin__InfluenzaA__ABU92726

SEQ ID NO: 154394 - RNA, 1701 nt, Artificial Sequence
  derived and/or modified sequence opt4 from hemagglutinin__InfluenzaA__ABU92727
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggacuucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154395 - RNA, 1701 nt, Artificial Sequence
  derived and/or modified sequence opt4 from hemagglutinin__InfluenzaA__ABU92728
augaagaccaucaucgcccugagcuacauccugugccagguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcgacaagagcuucuucagcagacugaacuggcugacccaccugaaguacaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154396 - RNA, 1701 nt, Artificial Sequence; identical to SEQ ID NO: 154395
  derived and/or modified sequence opt4 from hemagglutinin__InfluenzaA__ABU92729

SEQ ID NO: 154397 - RNA, 1701 nt, Artificial Sequence; identical to SEQ ID NO: 154273
  derived and/or modified sequence opt4 from hemagglutinin__InfluenzaA__ABU92730

SEQ ID NO: 154398 - RNA, 1701 nt, Artificial Sequence
  derived and/or modified sequence opt4 from hemagglutinin__InfluenzaA__ABU92731
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacguguggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154399 - RNA, 1701 nt, Artificial Sequence
  derived and/or modified sequence opt4 from hemagglutinin__InfluenzaA__ABU92732
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154400 - RNA, 1701 nt, Artificial Sequence
  derived and/or modified sequence opt4 from hemagglutinin__InfluenzaA__ABU92733
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagguggaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154401 - RNA, 1701 nt, Artificial Sequence; identical to SEQ ID NO: 154273
  derived and/or modified sequence opt4 from hemagglutinin__InfluenzaA__ABU92734

SEQ ID NO: 154402 - RNA, 1701 nt, Artificial Sequence
  derived and/or modified sequence opt4 from hemagglutinin__InfluenzaA__ABU92735
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcggcagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggcccccgccagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagauccugagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccugcugugcguggcccugcugggcuucaucaugugggccugccagaagggcaacaucagaugcaacaucugcaucuga

SEQ ID NO: 154403 - RNA, 1701 nt, Artificial Sequence; identical to SEQ ID NO: 154348
  derived and/or modified sequence opt4 from hemagglutinin__InfluenzaA__ABU92737

SEQ ID NO: 154404 - RNA, 1701 nt, Artificial Sequence
  derived and/or modified sequence opt4 from hemagglutinin__InfluenzaA__ABU92738
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggcccccggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154405 - RNA, 1701 nt, Artificial Sequence; identical to SEQ ID NO: 154282
  derived and/or modified sequence opt4 from hemagglutinin__InfluenzaA__ABU92739

SEQ ID NO: 154406 - RNA, 1701 nt, Artificial Sequence
  derived and/or modified sequence opt4 from hemagglutinin__InfluenzaA__ABU92740
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacacccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154407 - RNA, 1701 nt, Artificial Sequence
  derived and/or modified sequence opt4 from hemagglutinin__InfluenzaA__ABU92741
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucagccuguacgcccaggcccccggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacaucuacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154408 - RNA, 1701 nt, Artificial Sequence; identical to SEQ ID NO: 154348
  derived and/or modified sequence opt4 from hemagglutinin__InfluenzaA__ABU92742

SEQ ID NO: 154409 - RNA, 1701 nt, Artificial Sequence
  derived and/or modified sequence opt4 from hemagglutinin__InfluenzaA__ABU92743
augaagaccaucaucgcccugagcuacauccuguaccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154410 - RNA, 1701 nt, Artificial Sequence; identical to SEQ ID NO: 154348
  derived and/or modified sequence opt4 from hemagglutinin__InfluenzaA__ABU92744

SEQ ID NO: 154411 - RNA, 1701 nt, Artificial Sequence
  derived and/or modified sequence opt4 from hemagglutinin__InfluenzaA__ABU92745
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucagccuguacgcccaggcccccggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaaucggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154412 - RNA, 1701 nt, Artificial Sequence; identical to SEQ ID NO: 154348
  derived and/or modified sequence opt4 from hemagglutinin__InfluenzaA__ABU92746

SEQ ID NO: 154413 - RNA, 1701 nt, Artificial Sequence; identical to SEQ ID NO: 152593
  derived and/or modified sequence opt4 from hemagglutinin__InfluenzaA__ABU92747

SEQ ID NO: 154414 - RNA, 1701 nt, Artificial Sequence
  derived and/or modified sequence opt4 from hemagglutinin__InfluenzaA__ABU92748
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccacagcaaguucaaguaccccgcccugaacgugaccaugcccaacaacgagaaguucgacaagcuguacaucuggggcgugcaccaccccggcaccgacaacgaccagaccuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154415 - RNA, 1701 nt, Artificial Sequence; identical to SEQ ID NO: 152593
  derived and/or modified sequence opt4 from hemagglutinin__InfluenzaA__ABU92749

SEQ ID NO: 154416 - RNA, 1701 nt, Artificial Sequence
  derived and/or modified sequence opt4 from hemagglutinin__InfluenzaA__ABU92750
augaagaccaucaucgcccugagcuacauccugugccugguguucgcccagaagcugcccggcaacgacaacagaaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154417 - RNA, 1701 nt, Artificial Sequence
  derived and/or modified sequence opt4 from hemagglutinin__InfluenzaA__ABU92751
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154418 - RNA, 1701 nt, Artificial Sequence; identical to SEQ ID NO: 154282
  derived and/or modified sequence opt4 from hemagglutinin__InfluenzaA__ABU92752

SEQ ID NO: 154419 - RNA, 1701 nt, Artificial Sequence; identical to SEQ ID NO: 152593
  derived and/or modified sequence opt4 from hemagglutinin__InfluenzaA__ABU92753

SEQ ID NO: 154420 - RNA, 1701 nt, Artificial Sequence; identical to SEQ ID NO: 154282
  derived and/or modified sequence opt4 from hemagglutinin__InfluenzaA__ABU92754

SEQ ID NO: 154421 - RNA, 1701 nt, Artificial Sequence
  derived and/or modified sequence opt4 from hemagglutinin__InfluenzaA__ABU92755
augaagaccaucaucgcccugagcuacauccugugccugguguucgcccagaagcugcccggcaacgacaacggcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacgccgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154422 - RNA, 1701 nt, Artificial Sequence
  derived and/or modified sequence opt4 from hemagglutinin__InfluenzaA__ABU92756
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154423 - RNA, 1701 nt, Artificial Sequence
  derived and/or modified sequence opt4 from hemagglutinin__InfluenzaA__ABU92757
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcgacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagaggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154424 - RNA, 1701 nt, Artificial Sequence; identical to SEQ ID NO: 154282
  derived and/or modified sequence opt4 from hemagglutinin__InfluenzaA__ABU92758

SEQ ID NO: 154425 - RNA, 1701 nt, Artificial Sequence; identical to SEQ ID NO: 154282
  derived and/or modified sequence opt4 from hemagglutinin__InfluenzaA__ABU92759

SEQ ID NO: 154426 - RNA, 1701 nt, Artificial Sequence
  derived and/or modified sequence opt4 from hemagglutinin__InfluenzaA__ABU92760
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcgacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154427 - RNA, 1698 nt, Artificial Sequence
  derived and/or modified sequence opt4 from hemagglutinin__InfluenzaA__ABV29579
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154428 - RNA, 1698 nt, Artificial Sequence
  derived and/or modified sequence opt4 from hemagglutinin__InfluenzaA__ABV29612
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagguggccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154429 - RNA, 1698 nt, Artificial Sequence
  derived and/or modified sequence opt4 from hemagglutinin__InfluenzaA__ABV29634
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggaggcccccagccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154430 - RNA, 1698 nt, Artificial Sequence
  derived and/or modified sequence opt4 from hemagglutinin__InfluenzaA__ABV29645
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154431 - RNA, 1698 nt, Artificial Sequence; identical to SEQ ID NO: 154430
  derived and/or modified sequence opt4 from hemagglutinin__InfluenzaA__ABV29667

SEQ ID NO: 154432 - RNA, 1698 nt, Artificial Sequence
  derived and/or modified sequence opt4 from hemagglutinin__InfluenzaA__ABV29678
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccguggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154433 - RNA, 1698 nt, Artificial Sequence
  derived and/or modified sequence opt4 from hemagglutinin__InfluenzaA__ABV29689
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaucggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154434 - RNA, 1698 nt, Artificial Sequence
  derived and/or modified sequence opt4 from hemagglutinin__InfluenzaA__ABV29700
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154435 - RNA, 1701 nt, Artificial Sequence
  derived and/or modified sequence opt4 from hemagglutinin__InfluenzaA__ABV29711
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154436 - RNA, 1701 nt, Artificial Sequence
  derived and/or modified sequence opt4 from hemagglutinin__InfluenzaA__ABV29722
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguuccuggagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154437 - RNA, 1698 nt, Artificial Sequence
  derived and/or modified sequence opt4 from hemagglutinin__InfluenzaA__ABV29733
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacaagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154438 - RNA, 1698 nt, Artificial Sequence; identical to SEQ ID NO: 154430
  derived and/or modified sequence opt4 from hemagglutinin__InfluenzaA__ABV29744

SEQ ID NO: 154439 - RNA, 1698 nt, Artificial Sequence
  derived and/or modified sequence opt4 from hemagglutinin__InfluenzaA__ABV29755
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccagccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccaugggcaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154440 - RNA, 1698 nt, Artificial Sequence; identical to SEQ ID NO: 154430
  derived and/or modified sequence opt4 from hemagglutinin__InfluenzaA__ABV29766

SEQ ID NO: 154441 - RNA, 1698 nt, Artificial Sequence
  derived and/or modified sequence opt4 from hemagglutinin__InfluenzaA__ABV29777
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacaagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154442 - RNA, 1698 nt, Artificial Sequence; identical to SEQ ID NO: 154430
  derived and/or modified sequence opt4 from hemagglutinin__InfluenzaA__ABV29788

SEQ ID NO: 154443 - RNA, 1698 nt, Artificial Sequence; identical to SEQ ID NO: 154434
  derived and/or modified sequence opt4 from hemagglutinin__InfluenzaA__ABV29799

SEQ ID NO: 154444 - RNA, 1701 nt, Artificial Sequence
  derived and/or modified sequence opt4 from hemagglutinin__InfluenzaA__ABV29821
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagguguuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucaagugcaacaucugcaucuga

SEQ ID NO: 154445 - RNA, 1698 nt, Artificial Sequence; identical to SEQ ID NO: 154434
  derived and/or modified sequence opt4 from hemagglutinin__InfluenzaA__ABV29832

SEQ ID NO: 154446 - RNA, 1698 nt, Artificial Sequence; identical to SEQ ID NO: 154430
  derived and/or modified sequence opt4 from hemagglutinin__InfluenzaA__ABV29865

SEQ ID NO: 154447 - RNA, 1698 nt, Artificial Sequence; identical to SEQ ID NO: 154430
  derived and/or modified sequence opt4 from hemagglutinin__InfluenzaA__ABV29876

SEQ ID NO: 154448 - RNA, 1701 nt, Artificial Sequence
  derived and/or modified sequence opt4 from hemagglutinin__InfluenzaA__ABV29898
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154449 - RNA, 1701 nt, Artificial Sequence
  derived and/or modified sequence opt4 from hemagglutinin__InfluenzaA__ABV29909
augaagaccaucaucgcccugagcuacauccugugccugguguucgcccagaagcugcccggcaacgacaacagcaccgccacccugugccugggccaccacgccgugcccaacggcaccaucgugaagaccaucaccagcgaccagaucgaggugaccaacgccaccgagcuggugcagaacagcagcaucggcggcaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucagccuguacgcccaggcccccggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154450 - RNA, 1698 nt, Artificial Sequence
  derived and/or modified sequence opt4 from hemagglutinin__InfluenzaA__ABV29920
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154451 - RNA, 1698 nt, Artificial Sequence; identical to SEQ ID NO: 154441
  derived and/or modified sequence opt4 from hemagglutinin__InfluenzaA__ABV29942

SEQ ID NO: 154452 - RNA, 1698 nt, Artificial Sequence; identical to SEQ ID NO: 154434
  derived and/or modified sequence opt4 from hemagglutinin__InfluenzaA__ABV29953

SEQ ID NO: 154453 - RNA, 1698 nt, Artificial Sequence; identical to SEQ ID NO: 154434
  derived and/or modified sequence opt4 from hemagglutinin__InfluenzaA__ABV29964

SEQ ID NO: 154454 - RNA, 1698 nt, Artificial Sequence; identical to SEQ ID NO: 154430
  derived and/or modified sequence opt4 from hemagglutinin__InfluenzaA__ABV29986

SEQ ID NO: 154455 - RNA, 1698 nt, Artificial Sequence; identical to SEQ ID NO: 154434
  derived and/or modified sequence opt4 from hemagglutinin__InfluenzaA__ABV29997

SEQ ID NO: 154456 - RNA, 1698 nt, Artificial Sequence; identical to SEQ ID NO: 154430
  derived and/or modified sequence opt4 from hemagglutinin__InfluenzaA__ABV30008

SEQ ID NO: 154457 - RNA, 1698 nt, Artificial Sequence; identical to SEQ ID NO: 154434
  derived and/or modified sequence opt4 from hemagglutinin__InfluenzaA__ABV30019

SEQ ID NO: 154458 - RNA, 1698 nt, Artificial Sequence; identical to SEQ ID NO: 154434
  derived and/or modified sequence opt4 from hemagglutinin__InfluenzaA__ABV30030

SEQ ID NO: 154459 - RNA, 1698 nt, Artificial Sequence
  derived and/or modified sequence opt4 from hemagglutinin__InfluenzaA__ABV30041
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaccgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcugaucagccugggcgccaucagcuucuggaugugcagcaacggcagccugcagugcagaaucugcaucuga

SEQ ID NO: 154460 - RNA, 1701 nt, Artificial Sequence; identical to SEQ ID NO: 154448
  derived and/or modified sequence opt4 from hemagglutinin__InfluenzaA__ABV30063

SEQ ID NO: 154461 - RNA, 1701 nt, Artificial Sequence; identical to SEQ ID NO: 154448
  derived and/or modified sequence opt4 from hemagglutinin__InfluenzaA__ABV30074

SEQ ID NO: 154462 - RNA, 1698 nt, Artificial Sequence; identical to SEQ ID NO: 154434
  derived and/or modified sequence opt4 from hemagglutinin__InfluenzaA__ABV30085

SEQ ID NO: 154463 - RNA, 1698 nt, Artificial Sequence; identical to SEQ ID NO: 154434
  derived and/or modified sequence opt4 from hemagglutinin__InfluenzaA__ABV30096

SEQ ID NO: 154464 - RNA, 1698 nt, Artificial Sequence; identical to SEQ ID NO: 154430
  derived and/or modified sequence opt4 from hemagglutinin__InfluenzaA__ABV30107

SEQ ID NO: 154465 - RNA, 1698 nt, Artificial Sequence
  derived and/or modified sequence opt4 from hemagglutinin__InfluenzaA__ABV30129
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcaacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154466 - RNA, 1698 nt, Artificial Sequence
  derived and/or modified sequence opt4 from hemagglutinin__InfluenzaA__ABV30140
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagacacaacggcaagcugugccugcugaagggcaucgccccccugaagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcagaagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154467 - RNA, 1698 nt, Artificial Sequence
  derived and/or modified sequence opt4 from hemagglutinin__InfluenzaA__ABV30151
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacagcggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154468 - RNA, 1698 nt, Artificial Sequence
  derived and/or modified sequence opt4 from hemagglutinin__InfluenzaA__ABV30162
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154469 - RNA, 1698 nt, Artificial Sequence; identical to SEQ ID NO: 154434
  derived and/or modified sequence opt4 from hemagglutinin__InfluenzaA__ABV30173

SEQ ID NO: 154470 - RNA, 1698 nt, Artificial Sequence; identical to SEQ ID NO: 154434
  derived and/or modified sequence opt4 from hemagglutinin__InfluenzaA__ABV30184

SEQ ID NO: 154471 - RNA, 1701 nt, Artificial Sequence; identical to SEQ ID NO: 154448
  derived and/or modified sequence opt4 from hemagglutinin__InfluenzaA__ABV30217

SEQ ID NO: 154472 - RNA, 1701 nt, Artificial Sequence; identical to SEQ ID NO: 154448
  derived and/or modified sequence opt4 from hemagglutinin__InfluenzaA__ABV30228

SEQ ID NO: 154473 - RNA, 1701 nt, Artificial Sequence
  derived and/or modified sequence opt4 from hemagglutinin__InfluenzaA__ABV30261
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagguggaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaugggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagccgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154474 - RNA, 1701 nt, Artificial Sequence
  derived and/or modified sequence opt4 from hemagglutinin__InfluenzaA__ABV30272
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcaagcugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154475 - RNA, 1698 nt, Artificial Sequence
  derived and/or modified sequence opt4 from hemagglutinin__InfluenzaA__ABV30283
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcaacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154476 - RNA, 1698 nt, Artificial Sequence
  derived and/or modified sequence opt4 from hemagglutinin__InfluenzaA__ABV30294
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagacacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcagaagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154477 - RNA, 1698 nt, Artificial Sequence
  derived and/or modified sequence opt4 from hemagglutinin__InfluenzaA__ABV30305
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcggcagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154478 - RNA, 1698 nt, Artificial Sequence; identical to SEQ ID NO: 154430
  derived and/or modified sequence opt4 from hemagglutinin__InfluenzaA__ABV30316

SEQ ID NO: 154479 - RNA, 1698 nt, Artificial Sequence; identical to SEQ ID NO: 154476
  derived and/or modified sequence opt4 from hemagglutinin__InfluenzaA__ABV30327

SEQ ID NO: 154480 - RNA, 1698 nt, Artificial Sequence; identical to SEQ ID NO: 154430
  derived and/or modified sequence opt4 from hemagglutinin__InfluenzaA__ABV30338

SEQ ID NO: 154481 - RNA, 1698 nt, Artificial Sequence; identical to SEQ ID NO: 154434
  derived and/or modified sequence opt4 from hemagglutinin__InfluenzaA__ABV30349

SEQ ID NO: 154482 - RNA, 1698 nt, Artificial Sequence
  derived and/or modified sequence opt4 from hemagglutinin__InfluenzaA__ABV30360
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcaacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcaucaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154483 - RNA, 1698 nt, Artificial Sequence; identical to SEQ ID NO: 154434
  derived and/or modified sequence opt4 from hemagglutinin__InfluenzaA__ABV30371

SEQ ID NO: 154484 - RNA, 1701 nt, Artificial Sequence; identical to SEQ ID NO: 154249
  derived and/or modified sequence opt4 from hemagglutinin__InfluenzaA__ABV30382

SEQ ID NO: 154485 - RNA, 1701 nt, Artificial Sequence; identical to SEQ ID NO: 153150
  derived and/or modified sequence opt4 from hemagglutinin__InfluenzaA__ABV30393

SEQ ID NO: 154486 - RNA, 1701 nt, Artificial Sequence
  derived and/or modified sequence opt4 from hemagglutinin__InfluenzaA__ABV30404
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaagugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgaccugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154487 - RNA, 1701 nt, Artificial Sequence
  derived and/or modified sequence opt4 from hemagglutinin__InfluenzaA__ABV30415
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagagcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154488 - RNA, 1701 nt, Artificial Sequence; identical to SEQ ID NO: 154448
  derived and/or modified sequence opt4 from hemagglutinin__InfluenzaA__ABV30426

SEQ ID NO: 154489 - RNA, 1701 nt, Artificial Sequence
  derived and/or modified sequence opt4 from hemagglutinin__InfluenzaA__ABV30437
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaaccacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154490 - RNA, 1701 nt, Artificial Sequence; identical to SEQ ID NO: 154448
  derived and/or modified sequence opt4 from hemagglutinin__InfluenzaA__ABV30448

SEQ ID NO: 154491 - RNA, 1698 nt, Artificial Sequence
  derived and/or modified sequence opt4 from hemagglutinin__InfluenzaA__ABV30459
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggaggcccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154492 - RNA, 1701 nt, Artificial Sequence; identical to SEQ ID NO: 154448
  derived and/or modified sequence opt4 from hemagglutinin__InfluenzaA__ABV30470

SEQ ID NO: 154493 - RNA, 1698 nt, Artificial Sequence; identical to SEQ ID NO: 154430
  derived and/or modified sequence opt4 from hemagglutinin__InfluenzaA__ABV30492

SEQ ID NO: 154494 - RNA, 1698 nt, Artificial Sequence
  derived and/or modified sequence opt4 from hemagglutinin__InfluenzaA__ABV30503
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccaucaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154495 - RNA, 1701 nt, Artificial Sequence; identical to SEQ ID NO: 154448
  derived and/or modified sequence opt4 from hemagglutinin__InfluenzaA__ABV30514

SEQ ID NO: 154496 - RNA, 1698 nt, Artificial Sequence
  derived and/or modified sequence opt4 from hemagglutinin__InfluenzaA__ABV30525
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacagcggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacacccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154497 - RNA, 1698 nt, Artificial Sequence; identical to SEQ ID NO: 154434
  derived and/or modified sequence opt4 from hemagglutinin__InfluenzaA__ABV30536

SEQ ID NO: 154498 - RNA, 1698 nt, Artificial Sequence; identical to SEQ ID NO: 154441
  derived and/or modified sequence opt4 from hemagglutinin__InfluenzaA__ABV30547

SEQ ID NO: 154499 - RNA, 1698 nt, Artificial Sequence; identical to SEQ ID NO: 154434
  derived and/or modified sequence opt4 from hemagglutinin__InfluenzaA__ABV30558

SEQ ID NO: 154500 - RNA, 1698 nt, Artificial Sequence
  derived and/or modified sequence opt4 from hemagglutinin__InfluenzaA__ABV30569
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154501 - RNA, 1698 nt, Artificial Sequence; identical to SEQ ID NO: 154434
  derived and/or modified sequence opt4 from hemagglutinin__InfluenzaA__ABV30580

SEQ ID NO: 154502 - RNA, 1698 nt, Artificial Sequence; identical to SEQ ID NO: 154430
  derived and/or modified sequence opt4 from hemagglutinin__InfluenzaA__ABV30591

SEQ ID NO: 154503 - RNA, 1698 nt, Artificial Sequence; identical to SEQ ID NO: 154430
  derived and/or modified sequence opt4 from hemagglutinin__InfluenzaA__ABV30602

SEQ ID NO: 154504 - RNA, 1698 nt, Artificial Sequence
  derived and/or modified sequence opt4 from hemagglutinin__InfluenzaA__ABV30613
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaaugaagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154505 - RNA, 1698 nt, Artificial Sequence; identical to SEQ ID NO: 154430
  derived and/or modified sequence opt4 from hemagglutinin__InfluenzaA__ABV30624

SEQ ID NO: 154506 - RNA, 1701 nt, Artificial Sequence
  derived and/or modified sequence opt4 from hemagglutinin__InfluenzaA__ABV30646
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccuacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154507 - RNA, 1701 nt, Artificial Sequence
  derived and/or modified sequence opt4 from hemagglutinin__InfluenzaA__ABV30657
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagguguuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154508 - RNA, 1701 nt, Artificial Sequence; identical to SEQ ID NO: 154507
  derived and/or modified sequence opt4 from hemagglutinin__InfluenzaA__ABV45860

SEQ ID NO: 154509 - RNA, 1698 nt, Artificial Sequence; identical to SEQ ID NO: 154475
  derived and/or modified sequence opt4 from hemagglutinin__InfluenzaA__ABV45871

SEQ ID NO: 154510 - RNA, 1698 nt, Artificial Sequence; identical to SEQ ID NO: 154434
  derived and/or modified sequence opt4 from hemagglutinin__InfluenzaA__ABV45882

SEQ ID NO: 154511 - RNA, 1698 nt, Artificial Sequence; identical to SEQ ID NO: 154441
  derived and/or modified sequence opt4 from hemagglutinin__InfluenzaA__ABV45893

SEQ ID NO: 154512 - RNA, 1701 nt, Artificial Sequence; identical to SEQ ID NO: 154249
  derived and/or modified sequence opt4 from hemagglutinin__InfluenzaA__ABV45904

SEQ ID NO: 154513 - RNA, 1698 nt, Artificial Sequence; identical to SEQ ID NO: 154441
  derived and/or modified sequence opt4 from hemagglutinin__InfluenzaA__ABV45926

SEQ ID NO: 154514 - RNA, 1698 nt, Artificial Sequence
  derived and/or modified sequence opt4 from hemagglutinin__InfluenzaA__ABV45937
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgagaccaacggcaaccugaucgcccccagauucgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154515 - RNA, 1698 nt, Artificial Sequence; identical to SEQ ID NO: 154467
  derived and/or modified sequence opt4 from hemagglutinin__InfluenzaA__ABV45948

SEQ ID NO: 154516 - RNA, 1698 nt, Artificial Sequence; identical to SEQ ID NO: 154434
  derived and/or modified sequence opt4 from hemagglutinin__InfluenzaA__ABV45959

SEQ ID NO: 154517 - RNA, 1701 nt, Artificial Sequence
  derived and/or modified sequence opt4 from hemagglutinin__InfluenzaA__ABV45970
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154518 - RNA, 1701 nt, Artificial Sequence
  derived and/or modified sequence opt4 from hemagglutinin__InfluenzaA__ABV45981
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggaucaucuggaucagcuucgccaucagcugcuuccugcugugcguggcccugcugggcuucaucaugugggccugccagaagggcaacaucagaugcaacaucugcaucuga

SEQ ID NO: 154519 - RNA, 1698 nt, Artificial Sequence
  derived and/or modified sequence opt4 from hemagglutinin__InfluenzaA__ABV82551
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgagaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacaagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154520 - RNA, 1701 nt, Artificial Sequence; identical to SEQ ID NO: 154448
  derived and/or modified sequence opt4 from hemagglutinin__InfluenzaA__ABV82562

SEQ ID NO: 154521 - RNA, 1701 nt, Artificial Sequence; identical to SEQ ID NO: 154448
  derived and/or modified sequence opt4 from hemagglutinin__InfluenzaA__ABW36168

SEQ ID NO: 154522 - RNA, 1698 nt, Artificial Sequence; identical to SEQ ID NO: 154434
  derived and/or modified sequence opt4 from hemagglutinin__InfluenzaA__ABW36179

SEQ ID NO: 154523 - RNA, 1698 nt, Artificial Sequence; identical to SEQ ID NO: 154477
  derived and/or modified sequence opt4 from hemagglutinin__InfluenzaA__ABW36190

SEQ ID NO: 154524 - RNA, 1698 nt, Artificial Sequence; identical to SEQ ID NO: 154434
  derived and/or modified sequence opt4 from hemagglutinin__InfluenzaA__ABW36201

SEQ ID NO: 154525 - RNA, 1698 nt, Artificial Sequence
  derived and/or modified sequence opt4 from hemagglutinin__InfluenzaA__ABW36212
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagaacagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggccugggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagggccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154526 - RNA, 1698 nt, Artificial Sequence; identical to SEQ ID NO: 154430
  derived and/or modified sequence opt4 from hemagglutinin__InfluenzaA__ABW36223

SEQ ID NO: 154527 - RNA, 1698 nt, Artificial Sequence; identical to SEQ ID NO: 154430
  derived and/or modified sequence opt4 from hemagglutinin__InfluenzaA__ABW36245

SEQ ID NO: 154528 - RNA, 1698 nt, Artificial Sequence; identical to SEQ ID NO: 154430
  derived and/or modified sequence opt4 from hemagglutinin__InfluenzaA__ABW36267

SEQ ID NO: 154529 - RNA, 1698 nt, Artificial Sequence; identical to SEQ ID NO: 154434
  derived and/or modified sequence opt4 from hemagglutinin__InfluenzaA__ABW36278

SEQ ID NO: 154530 - RNA, 1698 nt, Artificial Sequence
  derived and/or modified sequence opt4 from hemagglutinin__InfluenzaA__ABW36289
augaagcugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154531 - RNA, 1698 nt, Artificial Sequence; identical to SEQ ID NO: 154441
  derived and/or modified sequence opt4 from hemagglutinin__InfluenzaA__ABW36300

SEQ ID NO: 154532 - RNA, 1701 nt, Artificial Sequence
  derived and/or modified sequence opt4 from hemagglutinin__InfluenzaA__ABW36311
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagaagcuggcccaagcacaacgugaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagcaacuacaacagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacaccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacagccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154533 - RNA, 1701 nt, Artificial Sequence
  derived and/or modified sequence opt4 from hemagglutinin__InfluenzaA__ABW38363
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugaucguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154534 - RNA, 1698 nt, Artificial Sequence
  derived and/or modified sequence opt4 from hemagglutinin__InfluenzaA__ABW39777
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagaacagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggccugggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154535 - RNA, 1698 nt, Artificial Sequence; identical to SEQ ID NO: 154434
  derived and/or modified sequence opt4 from hemagglutinin__InfluenzaA__ABW39806

SEQ ID NO: 154536 - RNA, 1698 nt, Artificial Sequence; identical to SEQ ID NO: 154441
  derived and/or modified sequence opt4 from hemagglutinin__InfluenzaA__ABW39817

SEQ ID NO: 154537 - RNA, 1698 nt, Artificial Sequence
  derived and/or modified sequence opt4 from hemagglutinin__InfluenzaA__ABW39828
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaugacccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154538 - RNA, 1698 nt, Artificial Sequence
  derived and/or modified sequence opt4 from hemagglutinin__InfluenzaA__ABW39839
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacagcaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugagaaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154539 - RNA, 1698 nt, Artificial Sequence
  derived and/or modified sequence opt4 from hemagglutinin__InfluenzaA__ABW39850
augaaggugaagcugcuggugcugcugugcaccuucaccgccaccaacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagggccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154540 - RNA, 1698 nt, Artificial Sequence; identical to SEQ ID NO: 154465
  derived and/or modified sequence opt4 from hemagglutinin__InfluenzaA__ABW39861

SEQ ID NO: 154541 - RNA, 1701 nt, Artificial Sequence; identical to SEQ ID NO: 154448
  derived and/or modified sequence opt4 from hemagglutinin__InfluenzaA__ABW39872

SEQ ID NO: 154542 - RNA, 1698 nt, Artificial Sequence
  derived and/or modified sequence opt4 from hemagglutinin__InfluenzaA__ABW39883
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccacaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154543 - RNA, 1698 nt, Artificial Sequence; identical to SEQ ID NO: 154475
  derived and/or modified sequence opt4 from hemagglutinin__InfluenzaA__ABW39894

SEQ ID NO: 154544 - RNA, 1698 nt, Artificial Sequence; identical to SEQ ID NO: 154430
  derived and/or modified sequence opt4 from hemagglutinin__InfluenzaA__ABW39905

SEQ ID NO: 154545 - RNA, 1698 nt, Artificial Sequence; identical to SEQ ID NO: 154434
  derived and/or modified sequence opt4 from hemagglutinin__InfluenzaA__ABW39927

SEQ ID NO: 154546 - RNA, 1701 nt, Artificial Sequence
  derived and/or modified sequence opt4 from hemagglutinin__InfluenzaA__ABW39938
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacgccuacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154547 - RNA, 1698 nt, Artificial Sequence; identical to SEQ ID NO: 154434
  derived and/or modified sequence opt4 from hemagglutinin__InfluenzaA__ABW39949

SEQ ID NO: 154548 - RNA, 1698 nt, Artificial Sequence; identical to SEQ ID NO: 154475
  derived and/or modified sequence opt4 from hemagglutinin__InfluenzaA__ABW39960

SEQ ID NO: 154549 - RNA, 1698 nt, Artificial Sequence; identical to SEQ ID NO: 154430
  derived and/or modified sequence opt4 from hemagglutinin__InfluenzaA__ABW39982

SEQ ID NO: 154550 - RNA, 1698 nt, Artificial Sequence; identical to SEQ ID NO: 154450
  derived and/or modified sequence opt4 from hemagglutinin__InfluenzaA__ABW39993

SEQ ID NO: 154551 - RNA, 1698 nt, Artificial Sequence; identical to SEQ ID NO: 154430
  derived and/or modified sequence opt4 from hemagglutinin__InfluenzaA__ABW40004

SEQ ID NO: 154552 - RNA, 1698 nt, Artificial Sequence; identical to SEQ ID NO: 154476
  derived and/or modified sequence opt4 from hemagglutinin__InfluenzaA__ABW40015

SEQ ID NO: 154553 - RNA, 1701 nt, Artificial Sequence; identical to SEQ ID NO: 154507
  derived and/or modified sequence opt4 from hemagglutinin__InfluenzaA__ABW40026

SEQ ID NO: 154554 - RNA, 1698 nt, Artificial Sequence; identical to SEQ ID NO: 154430
  derived and/or modified sequence opt4 from hemagglutinin__InfluenzaA__ABW40037

SEQ ID NO: 154555 - RNA, 1698 nt, Artificial Sequence
  derived and/or modified sequence opt4 from hemagglutinin__InfluenzaA__ABW40048
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagaagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154556 - RNA, 1698 nt, Artificial Sequence; identical to SEQ ID NO: 154434
  derived and/or modified sequence opt4 from hemagglutinin__InfluenzaA__ABW40059

SEQ ID NO: 154557 - RNA, 1698 nt, Artificial Sequence
  derived and/or modified sequence opt4 from hemagglutinin__InfluenzaA__ABW40070
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucaagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacagcaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154558 - RNA, 1701 nt, Artificial Sequence; identical to SEQ ID NO: 154448
  derived and/or modified sequence opt4 from hemagglutinin__InfluenzaA__ABW40081

SEQ ID NO: 154559 - RNA, 1698 nt, Artificial Sequence
  derived and/or modified sequence opt4 from hemagglutinin__InfluenzaA__ABW40092
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucaagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154560 - RNA, 1698 nt, Artificial Sequence; identical to SEQ ID NO: 154477
  derived and/or modified sequence opt4 from hemagglutinin__InfluenzaA__ABW40103

SEQ ID NO: 154561 - RNA, 1698 nt, Artificial Sequence
  derived and/or modified sequence opt4 from hemagglutinin__InfluenzaA__ABW40114
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcaccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154562 - RNA, 1698 nt, Artificial Sequence; identical to SEQ ID NO: 154430
  derived and/or modified sequence opt4 from hemagglutinin__InfluenzaA__ABW40125

SEQ ID NO: 154563 - RNA, 1701 nt, Artificial Sequence; identical to SEQ ID NO: 154448
  derived and/or modified sequence opt4 from hemagglutinin__InfluenzaA__ABW40136

SEQ ID NO: 154564 - RNA, 1698 nt, Artificial Sequence; identical to SEQ ID NO: 154465
  derived and/or modified sequence opt4 from hemagglutinin__InfluenzaA__ABW40147

SEQ ID NO: 154565 - RNA, 1698 nt, Artificial Sequence; identical to SEQ ID NO: 154434
  derived and/or modified sequence opt4 from hemagglutinin__InfluenzaA__ABW40158

SEQ ID NO: 154566 - RNA, 1698 nt, Artificial Sequence; identical to SEQ ID NO: 154434
  derived and/or modified sequence opt4 from hemagglutinin__InfluenzaA__ABW40180

SEQ ID NO: 154567 - RNA, 1701 nt, Artificial Sequence; identical to SEQ ID NO: 154448
  derived and/or modified sequence opt4 from hemagglutinin__InfluenzaA__ABW40191

SEQ ID NO: 154568 - RNA, 1698 nt, Artificial Sequence; identical to SEQ ID NO: 154450
  derived and/or modified sequence opt4 from hemagglutinin__InfluenzaA__ABW40202

SEQ ID NO: 154569 - RNA, 1698 nt, Artificial Sequence; identical to SEQ ID NO: 154430
  derived and/or modified sequence opt4 from hemagglutinin__InfluenzaA__ABW40213

SEQ ID NO: 154570 - RNA, 1698 nt, Artificial Sequence; identical to SEQ ID NO: 154430
  derived and/or modified sequence opt4 from hemagglutinin__InfluenzaA__ABW40224

SEQ ID NO: 154571 - RNA, 1698 nt, Artificial Sequence; identical to SEQ ID NO: 154434
  derived and/or modified sequence opt4 from hemagglutinin__InfluenzaA__ABW40235

SEQ ID NO: 154572 - RNA, 1701 nt, Artificial Sequence
  derived and/or modified sequence opt4 from hemagglutinin__InfluenzaA__ABW40246
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagguguuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucagaaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154573 - RNA, 1698 nt, Artificial Sequence
  derived and/or modified sequence opt4 from hemagglutinin__InfluenzaA__ABW40257
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154574 - RNA, 1701 nt, Artificial Sequence; identical to SEQ ID NO: 154507
  derived and/or modified sequence opt4 from hemagglutinin__InfluenzaA__ABW40268

SEQ ID NO: 154575 - RNA, 1698 nt, Artificial Sequence
  derived and/or modified sequence opt4 from hemagglutinin__InfluenzaA__ABW40312
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcagaagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154576 - RNA, 1701 nt, Artificial Sequence; identical to SEQ ID NO: 154448
  derived and/or modified sequence opt4 from hemagglutinin__InfluenzaA__ABW40323

SEQ ID NO: 154577 - RNA, 1698 nt, Artificial Sequence; identical to SEQ ID NO: 154476
  derived and/or modified sequence opt4 from hemagglutinin__InfluenzaA__ABW40334

SEQ ID NO: 154578 - RNA, 1698 nt, Artificial Sequence; identical to SEQ ID NO: 154476
  derived and/or modified sequence opt4 from hemagglutinin__InfluenzaA__ABW40345

SEQ ID NO: 154579 - RNA, 1698 nt, Artificial Sequence
  derived and/or modified sequence opt4 from hemagglutinin__InfluenzaA__ABW40356
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugauguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154580 - RNA, 1698 nt, Artificial Sequence; identical to SEQ ID NO: 154434
  derived and/or modified sequence opt4 from hemagglutinin__InfluenzaA__ABW40367

SEQ ID NO: 154581 - RNA, 1701 nt, Artificial Sequence; identical to SEQ ID NO: 154448
  derived and/or modified sequence opt4 from hemagglutinin__InfluenzaA__ABW40378

SEQ ID NO: 154582 - RNA, 1698 nt, Artificial Sequence; identical to SEQ ID NO: 154434
  derived and/or modified sequence opt4 from hemagglutinin__InfluenzaA__ABW40389

SEQ ID NO: 154583 - RNA, 1698 nt, Artificial Sequence; identical to SEQ ID NO: 154430
  derived and/or modified sequence opt4 from hemagglutinin__InfluenzaA__ABW40400

SEQ ID NO: 154584 - RNA, 1698 nt, Artificial Sequence; identical to SEQ ID NO: 154430
  derived and/or modified sequence opt4 from hemagglutinin__InfluenzaA__ABW40411

SEQ ID NO: 154585 - RNA, 1698 nt, Artificial Sequence; identical to SEQ ID NO: 154430
  derived and/or modified sequence opt4 from hemagglutinin__InfluenzaA__ABW40422

SEQ ID NO: 154586 - RNA, 1698 nt, Artificial Sequence; identical to SEQ ID NO: 154476
  derived and/or modified sequence opt4 from hemagglutinin__InfluenzaA__ABW40433

SEQ ID NO: 154587 - RNA, 1698 nt, Artificial Sequence; identical to SEQ ID NO: 154450
  derived and/or modified sequence opt4 from hemagglutinin__InfluenzaA__ABW40444

SEQ ID NO: 154588 - RNA, 1698 nt, Artificial Sequence; identical to SEQ ID NO: 154467
  derived and/or modified sequence opt4 from hemagglutinin__InfluenzaA__ABW40455

SEQ ID NO: 154589 - RNA, 1698 nt, Artificial Sequence; identical to SEQ ID NO: 154434
  derived and/or modified sequence opt4 from hemagglutinin__InfluenzaA__ABW40466

SEQ ID NO: 154590 - RNA, 1698 nt, Artificial Sequence; identical to SEQ ID NO: 154434
  derived and/or modified sequence opt4 from hemagglutinin__InfluenzaA__ABW40477

SEQ ID NO: 154591 - RNA, 1698 nt, Artificial Sequence; identical to SEQ ID NO: 154430
  derived and/or modified sequence opt4 from hemagglutinin__InfluenzaA__ABW40488

SEQ ID NO: 154592 - RNA, 1698 nt, Artificial Sequence; identical to SEQ ID NO: 154434
  derived and/or modified sequence opt4 from hemagglutinin__InfluenzaA__ABW40499

SEQ ID NO: 154593 - RNA, 1698 nt, Artificial Sequence; identical to SEQ ID NO: 154476
  derived and/or modified sequence opt4 from hemagglutinin__InfluenzaA__ABW40510

SEQ ID NO: 154594 - RNA, 1698 nt, Artificial Sequence; identical to SEQ ID NO: 154430
  derived and/or modified sequence opt4 from hemagglutinin__InfluenzaA__ABW40521

SEQ ID NO: 154595 - RNA, 1698 nt, Artificial Sequence; identical to SEQ ID NO: 154434
  derived and/or modified sequence opt4 from hemagglutinin__InfluenzaA__ABW40532

SEQ ID NO: 154596 - RNA, 1698 nt, Artificial Sequence
  derived and/or modified sequence opt4 from hemagglutinin__InfluenzaA__ABW40543
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagacacaacggcaagcugugccugcugaagggcaucgccccccugcagcugggcaacugcagcguggccggcuggauccugggcaaccccgagugcgagcugcugaccagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154597 - RNA, 1698 nt, Artificial Sequence; identical to SEQ ID NO: 154575
  derived and/or modified sequence opt4 from hemagglutinin__InfluenzaA__ABW40554

SEQ ID NO: 154598 - RNA, 1698 nt, Artificial Sequence; identical to SEQ ID NO: 154434
  derived and/or modified sequence opt4 from hemagglutinin__InfluenzaA__ABW40565

SEQ ID NO: 154599 - RNA, 1698 nt, Artificial Sequence
  derived and/or modified sequence opt4 from hemagglutinin__InfluenzaA__ABW40576
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacaccuacgugagcguggugagcagccacuacagcagaagauucacccccgagaucgccaagagacccaaggugagagaccaggagggcagaaucaacuacuacuggacccugcuggagcccggcgacaccaucauccuggaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154600 - RNA, 1701 nt, Artificial Sequence; identical to SEQ ID NO: 154507
  derived and/or modified sequence opt4 from hemagglutinin__InfluenzaA__ABW40587

SEQ ID NO: 154601 - RNA, 1698 nt, Artificial Sequence; identical to SEQ ID NO: 154476
  derived and/or modified sequence opt4 from hemagglutinin__InfluenzaA__ABW40598

SEQ ID NO: 154602 - RNA, 1698 nt, Artificial Sequence; identical to SEQ ID NO: 154450
  derived and/or modified sequence opt4 from hemagglutinin__InfluenzaA__ABW40609

SEQ ID NO: 154603 - RNA, 1698 nt, Artificial Sequence; identical to SEQ ID NO: 154465
  derived and/or modified sequence opt4 from hemagglutinin__InfluenzaA__ABW40620

SEQ ID NO: 154604 - RNA, 1701 nt, Artificial Sequence; identical to SEQ ID NO: 154507
  derived and/or modified sequence opt4 from hemagglutinin__InfluenzaA__ABW40631

SEQ ID NO: 154605 - RNA, 1698 nt, Artificial Sequence; identical to SEQ ID NO: 154430
  derived and/or modified sequence opt4 from hemagglutinin__InfluenzaA__ABW40642

SEQ ID NO: 154606 - RNA, 1701 nt, Artificial Sequence; identical to SEQ ID NO: 154507
  derived and/or modified sequence opt4 from hemagglutinin__InfluenzaA__ABW40653

SEQ ID NO: 154607 - RNA, 1698 nt, Artificial Sequence; identical to SEQ ID NO: 154476
  derived and/or modified sequence opt4 from hemagglutinin__InfluenzaA__ABW40664

SEQ ID NO: 154608 - RNA, 1698 nt, Artificial Sequence; identical to SEQ ID NO: 154450
  derived and/or modified sequence opt4 from hemagglutinin__InfluenzaA__ABW40675

SEQ ID NO: 154609 - RNA, 1698 nt, Artificial Sequence; identical to SEQ ID NO: 154579
  derived and/or modified sequence opt4 from hemagglutinin__InfluenzaA__ABW71294

SEQ ID NO: 154610 - RNA, 1698 nt, Artificial Sequence; identical to SEQ ID NO: 154476
  derived and/or modified sequence opt4 from hemagglutinin__InfluenzaA__ABW71305

SEQ ID NO: 154611 - RNA, 1698 nt, Artificial Sequence
  derived and/or modified sequence opt4 from hemagglutinin__InfluenzaA__ABW71316
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccagagacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154612 - RNA, 1698 nt, Artificial Sequence; identical to SEQ ID NO: 154430
  derived and/or modified sequence opt4 from hemagglutinin__InfluenzaA__ABW71327

SEQ ID NO: 154613 - RNA, 1698 nt, Artificial Sequence; identical to SEQ ID NO: 154434
  derived and/or modified sequence opt4 from hemagglutinin__InfluenzaA__ABW71338

SEQ ID NO: 154614 - RNA, 1701 nt, Artificial Sequence; identical to SEQ ID NO: 154448
  derived and/or modified sequence opt4 from hemagglutinin__InfluenzaA__ABW71349

SEQ ID NO: 154615 - RNA, 1698 nt, Artificial Sequence
  derived and/or modified sequence opt4 from hemagglutinin__InfluenzaA__ABW71360
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagacacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcagaagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154616 - RNA, 1698 nt, Artificial Sequence; identical to SEQ ID NO: 154450
  derived and/or modified sequence opt4 from hemagglutinin__InfluenzaA__ABW71371

SEQ ID NO: 154617 - RNA, 1698 nt, Artificial Sequence
  derived and/or modified sequence opt4 from hemagglutinin__InfluenzaA__ABW71382
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggagcaaccacaccaucaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154618 - RNA, 1698 nt, Artificial Sequence
  derived and/or modified sequence opt4 from hemagglutinin__InfluenzaA__ABW71393
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucaccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154619 - RNA, 1698 nt, Artificial Sequence; identical to SEQ ID NO: 154579
  derived and/or modified sequence opt4 from hemagglutinin__InfluenzaA__ABW71404

SEQ ID NO: 154620 - RNA, 1698 nt, Artificial Sequence; identical to SEQ ID NO: 154467
  derived and/or modified sequence opt4 from hemagglutinin__InfluenzaA__ABW71415

SEQ ID NO: 154621 - RNA, 1698 nt, Artificial Sequence
  derived and/or modified sequence opt4 from hemagglutinin__InfluenzaA__ABW71426
augaaggccaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154622 - RNA, 1698 nt, Artificial Sequence
  derived and/or modified sequence opt4 from hemagglutinin__InfluenzaA__ABW71448
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccaucgccagcagccuggugcugcuggugagccugggcgccaucagcuucuggaugugcagcaacggcagccugcagugcagaaucugcaucuga

SEQ ID NO: 154623 - RNA, 1698 nt, Artificial Sequence; identical to SEQ ID NO: 154450
  derived and/or modified sequence opt4 from hemagglutinin__InfluenzaA__ABW71459

SEQ ID NO: 154624 - RNA, 1698 nt, Artificial Sequence; identical to SEQ ID NO: 154434
  derived and/or modified sequence opt4 from hemagglutinin__InfluenzaA__ABW71470

SEQ ID NO: 154625 - RNA, 1707 nt, Artificial Sequence
  derived and/or modified sequence opt4 from hemagglutinin__InfluenzaA__ABW74702
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagcagcagcuucuucagaaacgugguguggcugaucaagaagaacagcaccuaccccaccaucaagaagagcuacaacaacaccaaccaggaggaccugcuggugcuguggggcauccaccaccccaacgacgccgccgagcagaccagacuguaccagaaccccaccaccuacaucagcaucggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcaucgagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugauggccggccugagccuguggaugugcagcaacggcagccugcagugcagaaucugcaucuga

SEQ ID NO: 154626 - RNA, 1707 nt, Artificial Sequence
  derived and/or modified sequence opt4 from hemagglutinin__InfluenzaA__ABW74703
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugaaggacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaagagcuacaacaacaccaaccaggaggaccugcuggugcuguggggcauccaccaccccaacgacgccgccgagcagaccagacuguaccagaaccccaccaccuacaucagcaucggcaccagcacccugaaccagagacuggugcccaagaucgccaccagaagcaaggugaacggccagagcggcagaauggaguucuucuggaccauccugaagcccaacgacgccgugaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacagccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugaucgccggccugagccuguggaugugcagcaacggcagccugcagugcagaaucugcaucuga

SEQ ID NO: 154627 - RNA, 1707 nt, Artificial Sequence
  derived and/or modified sequence opt4 from hemagglutinin__InfluenzaA__ABW74705
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaagagcuacaacaacaccaaccaggaggaccugcuggugcuguggggcauccaccaccccaacgacgccgccgagcagaccagacuguaccagaaccccaccaccuacaucagcaucggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugaucgccggccugagccuguggaugugcagcaacggcagccugcagugcagaaucugcaucuga

SEQ ID NO: 154628 - RNA, 1707 nt, Artificial Sequence
  derived and/or modified sequence opt4 from hemagglutinin__InfluenzaA__ABW74707
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaagagcuacaacaacaccaaccaggaggaccugcuggugcuguggggcauccaccaccccaacgacgccgccgagcagaccagacuguaccagaaccccaccaccuacaucagcaucggcaccagcacccugaaccagagacuggugcccaagauggccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugaucgccggccugagccuguggaugugcagcaacggcagccugcagugcagaaucugcaucuga

SEQ ID NO: 154629 - RNA, 1707 nt, Artificial Sequence
  derived and/or modified sequence opt4 from hemagglutinin__InfluenzaA__ABW74708
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaagagcuacaacaacaccaaccaggaggaccugcuggugcuguggggcauccaccaccccaacgacgccgccgagcagaccagacuguaccagaaccccaccaccuacaucagcaucggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagaagcgugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugauggccggccugagccuguggaugugcagcaacggcagccugcagugcagaaucugcaucuga

SEQ ID NO: 154630 - RNA, 1707 nt, Artificial Sequence; identical to SEQ ID NO: 154627
  derived and/or modified sequence opt4 from hemagglutinin__InfluenzaA__ABW74710

SEQ ID NO: 154631 - RNA, 1707 nt, Artificial Sequence; identical to SEQ ID NO: 154627
  derived and/or modified sequence opt4 from hemagglutinin__InfluenzaA__ABW74711

SEQ ID NO: 154632 - RNA, 1707 nt, Artificial Sequence
  derived and/or modified sequence opt4 from hemagglutinin__InfluenzaA__ABW74712
auggagaagaucgugcugcugcugagcaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaagagcuacaacaacaccaaccaggaggaccugcuggugcuguggggcauccaccaccccaacaacgaggaggagcagaccagacuguaccagaaccccaccaccuacaucagcaucggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacagcaacugcaacaccaagugccagacccccaugggcgccaucaacagcagcaugcccuuccacaacauccacccccugaccaucggcgagugccccaaguacgugaagagcagcagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugaucgccggccugagccuguggaugugcagcaacggcagccugcagugcagaaucugcaucuga

SEQ ID NO: 154633 - RNA, 1701 nt, Artificial Sequence
  derived and/or modified sequence opt4 from hemagglutinin__InfluenzaA__ABW80976
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccagcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagcaucuacgcccaggccagcggcagagugaccgugagcaccaagagaagccagcagaccgugauccccaacaucggcagcagacccugggugagaggcgugagcagcggcaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 154634 - RNA, 1701 nt, Artificial Sequence
  derived and/or modified sequence opt4 from hemagglutinin__InfluenzaA__ABW80977
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucaaccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucagcagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154635 - RNA, 1698 nt, Artificial Sequence
  derived and/or modified sequence opt4 from hemagglutinin__InfluenzaA__ABW80979
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgugaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154636 - RNA, 1701 nt, Artificial Sequence
  derived and/or modified sequence opt4 from hemagglutinin__InfluenzaA__ABW81505
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcaucgccggcuggauccugggcaaccccgagugcgagagccuguucagcaaggagagcuggagcuacaucgccgagacccccaaccccaagaacggcaccugcuaccccggcuacuucgccgacuacgaggagcugagagagcagcugagcagcgugagcagcuucgagagauucgagaucuuccccaaggacagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaagaagggcaaggaggugcuggugcuguggggcgugcaccaccccagcaacaugggcgaccagagagccaucuaccacaaggagaacgccuacgugagcgugcugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaucagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacgugcccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagacccagcugaagaacaacgccaaggagaucggcaacggcugcuucgaguucuaccacaagugcaacaacgagugcauggagagcgugaagaacggcaccuacgacuaccccaaguacagcaaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154637 - RNA, 1698 nt, Artificial Sequence
  derived and/or modified sequence opt4 from hemagglutinin__InfluenzaA__ABW81506
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 154638 - RNA, 1701 nt, Artificial Sequence
  derived and/or modified sequence opt4 from hemagglutinin__InfluenzaA__ABW81507
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgugccccugcagcugggcaacugcagcaucgccggcuggauccugggcaaccccgagugcgagagccuguucagcaaggagagcuggagcuacaucgccgagacccccaaccccaagaacggcaccugcuaccccggcuacuucgccgacuacgaggagcugagagagcagcugagcagcgugagcagcuucgagagauucgagaucuuccccaaggacagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaagaagggcaaggaggugcuggugcuguggggcgugcaccaccccagcaacaugggcgaccagagagccaucuaccacaaggagaacgccuacgugagcgugcugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaucagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacgugcccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagacccagcugaagaacaacgccaaggagaucggcaacggcugcuucgaguucuaccacaagugcaacaacgagugcauggagagcgugaagaacggcaccuacgacuaccccaaguacagcaaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154639 - RNA, 1698 nt, Artificial Sequence
  derived and/or modified sequence opt4 from hemagglutinin__InfluenzaA__ABW81508
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccagaaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154640 - RNA, 1701 nt, Artificial Sequence; identical to SEQ ID NO: 154636
  derived and/or modified sequence opt4 from hemagglutinin__InfluenzaA__ABW81509

SEQ ID NO: 154641 - RNA, 1698 nt, Artificial Sequence
  derived and/or modified sequence opt4 from hemagglutinin__InfluenzaA__ABW81511
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacagcaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154642 - RNA, 1698 nt, Artificial Sequence; identical to SEQ ID NO: 152816
  derived and/or modified sequence opt4 from hemagglutinin__InfluenzaA__ABW81512

SEQ ID NO: 154643 - RNA, 1698 nt, Artificial Sequence; identical to SEQ ID NO: 153905
  derived and/or modified sequence opt4 from hemagglutinin__InfluenzaA__ABW81513

SEQ ID NO: 154644 - RNA, 1698 nt, Artificial Sequence
  derived and/or modified sequence opt4 from hemagglutinin__InfluenzaA__ABW81514
augaaggugaagcugcuggugcugcugugcaccuucaccgccaccuacgccgacaccaucugcaucagcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154645 - RNA, 1698 nt, Artificial Sequence; identical to SEQ ID NO: 153905
  derived and/or modified sequence opt4 from hemagglutinin__InfluenzaA__ABW81515

SEQ ID NO: 154646 - RNA, 1698 nt, Artificial Sequence; identical to SEQ ID NO: 153905
  derived and/or modified sequence opt4 from hemagglutinin__InfluenzaA__ABW81516

SEQ ID NO: 154647 - RNA, 1698 nt, Artificial Sequence
  derived and/or modified sequence opt4 from hemagglutinin__InfluenzaA__ABW81517
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcaucagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154648 - RNA, 1698 nt, Artificial Sequence
  derived and/or modified sequence opt4 from hemagglutinin__InfluenzaA__ABW81518
augaaggugaagcugcuggugcugcugugcaccuacaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154649 - RNA, 1698 nt, Artificial Sequence
  derived and/or modified sequence opt4 from hemagglutinin__InfluenzaA__ABW81519
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgcccacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154650 - RNA, 1698 nt, Artificial Sequence
  derived and/or modified sequence opt4 from hemagglutinin__InfluenzaA__ABW81520
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcagcugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154651 - RNA, 1698 nt, Artificial Sequence
  derived and/or modified sequence opt4 from hemagglutinin__InfluenzaA__ABW81521
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucagcagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154652 - RNA, 1698 nt, Artificial Sequence; identical to SEQ ID NO: 153905
  derived and/or modified sequence opt4 from hemagglutinin__InfluenzaA__ABW81522

SEQ ID NO: 154653 - RNA, 1698 nt, Artificial Sequence; identical to SEQ ID NO: 153905
  derived and/or modified sequence opt4 from hemagglutinin__InfluenzaA__ABW81523

SEQ ID NO: 154654 - RNA, 1698 nt, Artificial Sequence
  derived and/or modified sequence opt4 from hemagglutinin__InfluenzaA__ABW81524
augaaggugaagcugcuggugcugcugugcaccuucaccgccaccuacgccgacaccaucugcaucggcuaccacgccaacaacagcaccgacaccaucgacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154655 - RNA, 1698 nt, Artificial Sequence
  derived and/or modified sequence opt4 from hemagglutinin__InfluenzaA__ABW81526
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccaugggcaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggaccugcacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154656 - RNA, 1698 nt, Artificial Sequence
  derived and/or modified sequence opt4 from hemagglutinin__InfluenzaA__ABW81527
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagaaaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154657 - RNA, 1698 nt, Artificial Sequence
  derived and/or modified sequence opt4 from hemagglutinin__InfluenzaA__ABW81528
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcauccaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccagagacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154658 - RNA, 1698 nt, Artificial Sequence
  derived and/or modified sequence opt4 from hemagglutinin__InfluenzaA__ABW81529
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucagagaccagaugacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagacccccaagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154659 - RNA, 1698 nt, Artificial Sequence
  derived and/or modified sequence opt4 from hemagglutinin__InfluenzaA__ABW81530
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacagaaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154660 - RNA, 1698 nt, Artificial Sequence; identical to SEQ ID NO: 152846
  derived and/or modified sequence opt4 from hemagglutinin__InfluenzaA__ABW81531

SEQ ID NO: 154661 - RNA, 1698 nt, Artificial Sequence
  derived and/or modified sequence opt4 from hemagglutinin__InfluenzaA__ABW81532
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccugguacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcaaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154662 - RNA, 1698 nt, Artificial Sequence; identical to SEQ ID NO: 154476
  derived and/or modified sequence opt4 from hemagglutinin__InfluenzaA__ABW86321

SEQ ID NO: 154663 - RNA, 1698 nt, Artificial Sequence; identical to SEQ ID NO: 154441
  derived and/or modified sequence opt4 from hemagglutinin__InfluenzaA__ABW86332

SEQ ID NO: 154664 - RNA, 1698 nt, Artificial Sequence; identical to SEQ ID NO: 154430
  derived and/or modified sequence opt4 from hemagglutinin__InfluenzaA__ABW86343

SEQ ID NO: 154665 - RNA, 1698 nt, Artificial Sequence; identical to SEQ ID NO: 154434
  derived and/or modified sequence opt4 from hemagglutinin__InfluenzaA__ABW86354

SEQ ID NO: 154666 - RNA, 1698 nt, Artificial Sequence; identical to SEQ ID NO: 154434
  derived and/or modified sequence opt4 from hemagglutinin__InfluenzaA__ABW86365

SEQ ID NO: 154667 - RNA, 1698 nt, Artificial Sequence; identical to SEQ ID NO: 154450
  derived and/or modified sequence opt4 from hemagglutinin__InfluenzaA__ABW86376

SEQ ID NO: 154668 - RNA, 1698 nt, Artificial Sequence; identical to SEQ ID NO: 154434
  derived and/or modified sequence opt4 from hemagglutinin__InfluenzaA__ABW86387

SEQ ID NO: 154669 - RNA, 1698 nt, Artificial Sequence; identical to SEQ ID NO: 154430
  derived and/or modified sequence opt4 from hemagglutinin__InfluenzaA__ABW86409

SEQ ID NO: 154670 - RNA, 1698 nt, Artificial Sequence; identical to SEQ ID NO: 154430
  derived and/or modified sequence opt4 from hemagglutinin__InfluenzaA__ABW86431

SEQ ID NO: 154671 - RNA, 1698 nt, Artificial Sequence; identical to SEQ ID NO: 154434
  derived and/or modified sequence opt4 from hemagglutinin__InfluenzaA__ABW86442

SEQ ID NO: 154672 - RNA, 1698 nt, Artificial Sequence; identical to SEQ ID NO: 154450
  derived and/or modified sequence opt4 from hemagglutinin__InfluenzaA__ABW86453

SEQ ID NO: 154673 - RNA, 1698 nt, Artificial Sequence; identical to SEQ ID NO: 154434
  derived and/or modified sequence opt4 from hemagglutinin__InfluenzaA__ABW86464

SEQ ID NO: 154674 - RNA, 1698 nt, Artificial Sequence; identical to SEQ ID NO: 154450
  derived and/or modified sequence opt4 from hemagglutinin__InfluenzaA__ABW86475

SEQ ID NO: 154675 - RNA, 1698 nt, Artificial Sequence; identical to SEQ ID NO: 154430
  derived and/or modified sequence opt4 from hemagglutinin__InfluenzaA__ABW86486

SEQ ID NO: 154676 - RNA, 1698 nt, Artificial Sequence; identical to SEQ ID NO: 154476
  derived and/or modified sequence opt4 from hemagglutinin__InfluenzaA__ABW86497

SEQ ID NO: 154677 - RNA, 1698 nt, Artificial Sequence; identical to SEQ ID NO: 154434
  derived and/or modified sequence opt4 from hemagglutinin__InfluenzaA__ABW86508

SEQ ID NO: 154678 - RNA, 1698 nt, Artificial Sequence
  derived and/or modified sequence opt4 from hemagglutinin__InfluenzaA__ABW86519
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagaaaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154679 - RNA, 1698 nt, Artificial Sequence; identical to SEQ ID NO: 154430
  derived and/or modified sequence opt4 from hemagglutinin__InfluenzaA__ABW86530

SEQ ID NO: 154680 - RNA, 1698 nt, Artificial Sequence
  derived and/or modified sequence opt4 from hemagglutinin__InfluenzaA__ABW86541
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcugaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154681 - RNA, 1698 nt, Artificial Sequence; identical to SEQ ID NO: 154430
  derived and/or modified sequence opt4 from hemagglutinin__InfluenzaA__ABW86552

SEQ ID NO: 154682 - RNA, 1701 nt, Artificial Sequence
  derived and/or modified sequence opt4 from hemagglutinin__InfluenzaA__ABW86563
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggccacaaggacuggauccuguggaucagcuucgccaucagcugcuuccugcugugcguggcccugcugggcuucaucaugugggccugccagaagggcaacaucagaugcaacaucugcaucuga

SEQ ID NO: 154683 - RNA, 1698 nt, Artificial Sequence; identical to SEQ ID NO: 154467
  derived and/or modified sequence opt4 from hemagglutinin__InfluenzaA__ABW86606

SEQ ID NO: 154684 - RNA, 1701 nt, Artificial Sequence; identical to SEQ ID NO: 153441
  derived and/or modified sequence opt4 from hemagglutinin__InfluenzaA__ABW91185

SEQ ID NO: 154685 - RNA, 1701 nt, Artificial Sequence
  derived and/or modified sequence opt4 from hemagglutinin__InfluenzaA__ABW91196
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154686 - RNA, 1701 nt, Artificial Sequence; identical to SEQ ID NO: 154685
  derived and/or modified sequence opt4 from hemagglutinin__InfluenzaA__ABW91207

SEQ ID NO: 154687 - RNA, 1698 nt, Artificial Sequence; identical to SEQ ID NO: 154430
  derived and/or modified sequence opt4 from hemagglutinin__InfluenzaA__ABW91218

SEQ ID NO: 154688 - RNA, 1701 nt, Artificial Sequence; identical to SEQ ID NO: 154448
  derived and/or modified sequence opt4 from hemagglutinin__InfluenzaA__ABW91240

SEQ ID NO: 154689 - RNA, 1701 nt, Artificial Sequence
  derived and/or modified sequence opt4 from hemagglutinin__InfluenzaA__ABW91251
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagagcggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154690 - RNA, 1701 nt, Artificial Sequence; identical to SEQ ID NO: 154448
  derived and/or modified sequence opt4 from hemagglutinin__InfluenzaA__ABW91262

SEQ ID NO: 154691 - RNA, 1698 nt, Artificial Sequence; identical to SEQ ID NO: 154465
  derived and/or modified sequence opt4 from hemagglutinin__InfluenzaA__ABW91273

SEQ ID NO: 154692 - RNA, 1698 nt, Artificial Sequence
  derived and/or modified sequence opt4 from hemagglutinin__InfluenzaA__ABW91284
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccaccaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgccagcaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154693 - RNA, 1698 nt, Artificial Sequence; identical to SEQ ID NO: 154465
  derived and/or modified sequence opt4 from hemagglutinin__InfluenzaA__ABW91295

SEQ ID NO: 154694 - RNA, 1698 nt, Artificial Sequence; identical to SEQ ID NO: 154434
  derived and/or modified sequence opt4 from hemagglutinin__InfluenzaA__ABW91306

SEQ ID NO: 154695 - RNA, 1698 nt, Artificial Sequence; identical to SEQ ID NO: 154434
  derived and/or modified sequence opt4 from hemagglutinin__InfluenzaA__ABW91317

SEQ ID NO: 154696 - RNA, 1698 nt, Artificial Sequence
  derived and/or modified sequence opt4 from hemagglutinin__InfluenzaA__ABW91328
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugagaagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154697 - RNA, 1698 nt, Artificial Sequence; identical to SEQ ID NO: 154434
  derived and/or modified sequence opt4 from hemagglutinin__InfluenzaA__ABW91339

SEQ ID NO: 154698 - RNA, 1698 nt, Artificial Sequence; identical to SEQ ID NO: 154434
  derived and/or modified sequence opt4 from hemagglutinin__InfluenzaA__ABW91350

SEQ ID NO: 154699 - RNA, 1698 nt, Artificial Sequence
  derived and/or modified sequence opt4 from hemagglutinin__InfluenzaA__ABW91361
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacaagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagaccagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154700 - RNA, 1698 nt, Artificial Sequence; identical to SEQ ID NO: 154434
  derived and/or modified sequence opt4 from hemagglutinin__InfluenzaA__ABW91372

SEQ ID NO: 154701 - RNA, 1698 nt, Artificial Sequence; identical to SEQ ID NO: 154467
  derived and/or modified sequence opt4 from hemagglutinin__InfluenzaA__ABW91383

SEQ ID NO: 154702 - RNA, 1701 nt, Artificial Sequence; identical to SEQ ID NO: 154507
  derived and/or modified sequence opt4 from hemagglutinin__InfluenzaA__ABW91394

SEQ ID NO: 154703 - RNA, 1698 nt, Artificial Sequence; identical to SEQ ID NO: 154476
  derived and/or modified sequence opt4 from hemagglutinin__InfluenzaA__ABW91405

SEQ ID NO: 154704 - RNA, 1698 nt, Artificial Sequence
  derived and/or modified sequence opt4 from hemagglutinin__InfluenzaA__ABW91416
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154705 - RNA, 1698 nt, Artificial Sequence; identical to SEQ ID NO: 154579
  derived and/or modified sequence opt4 from hemagglutinin__InfluenzaA__ABW91427

SEQ ID NO: 154706 - RNA, 1701 nt, Artificial Sequence; identical to SEQ ID NO: 154448
  derived and/or modified sequence opt4 from hemagglutinin__InfluenzaA__ABW91438

SEQ ID NO: 154707 - RNA, 1698 nt, Artificial Sequence; identical to SEQ ID NO: 154476
  derived and/or modified sequence opt4 from hemagglutinin__InfluenzaA__ABW91449

SEQ ID NO: 154708 - RNA, 1698 nt, Artificial Sequence; identical to SEQ ID NO: 154476
  derived and/or modified sequence opt4 from hemagglutinin__InfluenzaA__ABW91460

SEQ ID NO: 154709 - RNA, 1698 nt, Artificial Sequence
  derived and/or modified sequence opt4 from hemagglutinin__InfluenzaA__ABW91471
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcguggccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154710 - RNA, 1698 nt, Artificial Sequence
  derived and/or modified sequence opt4 from hemagglutinin__InfluenzaA__ABW91482
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagacacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcagaagcagcuucuacagaaaccugcuguggcugaccggcaagaacggccuguaccccaaccugagcagaagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154711 - RNA, 1698 nt, Artificial Sequence
  derived and/or modified sequence opt4 from hemagglutinin__InfluenzaA__ABW91493
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154712 - RNA, 1698 nt, Artificial Sequence; identical to SEQ ID NO: 154450
  derived and/or modified sequence opt4 from hemagglutinin__InfluenzaA__ABW91504

SEQ ID NO: 154713 - RNA, 1698 nt, Artificial Sequence
  derived and/or modified sequence opt4 from hemagglutinin__InfluenzaA__ABW91515
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagacacaacggcaagcugugccugcugaagggcaucgccccccugcagcugggcaacugcagcguggccggcuggauccugggcaaccccgagugcgagcugcugaucagcaaggagagcuggagcuacgugguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154714 - RNA, 1698 nt, Artificial Sequence
  derived and/or modified sequence opt4 from hemagglutinin__InfluenzaA__ABW91526
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagagcaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccagacugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154715 - RNA, 1698 nt, Artificial Sequence; identical to SEQ ID NO: 154434
  derived and/or modified sequence opt4 from hemagglutinin__InfluenzaA__ABW91537

SEQ ID NO: 154716 - RNA, 1701 nt, Artificial Sequence; identical to SEQ ID NO: 154507
  derived and/or modified sequence opt4 from hemagglutinin__InfluenzaA__ABW91548

SEQ ID NO: 154717 - RNA, 1698 nt, Artificial Sequence
  derived and/or modified sequence opt4 from hemagglutinin__InfluenzaA__ABW91559
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcuguacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154718 - RNA, 1698 nt, Artificial Sequence; identical to SEQ ID NO: 154575
  derived and/or modified sequence opt4 from hemagglutinin__InfluenzaA__ABW91570

SEQ ID NO: 154719 - RNA, 1698 nt, Artificial Sequence; identical to SEQ ID NO: 154450
  derived and/or modified sequence opt4 from hemagglutinin__InfluenzaA__ABW91581

SEQ ID NO: 154720 - RNA, 1698 nt, Artificial Sequence; identical to SEQ ID NO: 154430
  derived and/or modified sequence opt4 from hemagglutinin__InfluenzaA__ABW91592

SEQ ID NO: 154721 - RNA, 1698 nt, Artificial Sequence; identical to SEQ ID NO: 154476
  derived and/or modified sequence opt4 from hemagglutinin__InfluenzaA__ABW91603

SEQ ID NO: 154722 - RNA, 1698 nt, Artificial Sequence
  derived and/or modified sequence opt4 from hemagglutinin__InfluenzaA__ABW91614
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccagccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucagcagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154723 - RNA, 1698 nt, Artificial Sequence; identical to SEQ ID NO: 154465
  derived and/or modified sequence opt4 from hemagglutinin__InfluenzaA__ABW91625

SEQ ID NO: 154724 - RNA, 1698 nt, Artificial Sequence; identical to SEQ ID NO: 154434
  derived and/or modified sequence opt4 from hemagglutinin__InfluenzaA__ABW91636

SEQ ID NO: 154725 - RNA, 1701 nt, Artificial Sequence; identical to SEQ ID NO: 154507
  derived and/or modified sequence opt4 from hemagglutinin__InfluenzaA__ABW91647

SEQ ID NO: 154726 - RNA, 1707 nt, Artificial Sequence
  derived and/or modified sequence opt4 from hemagglutinin__InfluenzaA__ABX10515
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggugagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugaaggacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 154727 - RNA, 1701 nt, Artificial Sequence; identical to SEQ ID NO: 154376
  derived and/or modified sequence opt4 from hemagglutinin__InfluenzaA__ABX10525

SEQ ID NO: 154728 - RNA, 1698 nt, Artificial Sequence; identical to SEQ ID NO: 154434
  derived and/or modified sequence opt4 from hemagglutinin__InfluenzaA__ABX58239

SEQ ID NO: 154729 - RNA, 1698 nt, Artificial Sequence; identical to SEQ ID NO: 154534
  derived and/or modified sequence opt4 from hemagglutinin__InfluenzaA__ABX58250

SEQ ID NO: 154730 - RNA, 1698 nt, Artificial Sequence
  derived and/or modified sequence opt4 from hemagglutinin__InfluenzaA__ABX58261
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggagccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154731 - RNA, 1698 nt, Artificial Sequence
  derived and/or modified sequence opt4 from hemagglutinin__InfluenzaA__ABX58272
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagaagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154732 - RNA, 1698 nt, Artificial Sequence; identical to SEQ ID NO: 154434
  derived and/or modified sequence opt4 from hemagglutinin__InfluenzaA__ABX58283

SEQ ID NO: 154733 - RNA, 1698 nt, Artificial Sequence; identical to SEQ ID NO: 154575
  derived and/or modified sequence opt4 from hemagglutinin__InfluenzaA__ABX58294

SEQ ID NO: 154734 - RNA, 1698 nt, Artificial Sequence; identical to SEQ ID NO: 154430
  derived and/or modified sequence opt4 from hemagglutinin__InfluenzaA__ABX58316

SEQ ID NO: 154735 - RNA, 1698 nt, Artificial Sequence; identical to SEQ ID NO: 154579
  derived and/or modified sequence opt4 from hemagglutinin__InfluenzaA__ABX58327

SEQ ID NO: 154736 - RNA, 1698 nt, Artificial Sequence; identical to SEQ ID NO: 154430
  derived and/or modified sequence opt4 from hemagglutinin__InfluenzaA__ABX58338

SEQ ID NO: 154737 - RNA, 1698 nt, Artificial Sequence
  derived and/or modified sequence opt4 from hemagglutinin__InfluenzaA__ABX58360
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgcccccauccagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacggcugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154738 - RNA, 1698 nt, Artificial Sequence; identical to SEQ ID NO: 154434
  derived and/or modified sequence opt4 from hemagglutinin__InfluenzaA__ABX58371

SEQ ID NO: 154739 - RNA, 1698 nt, Artificial Sequence; identical to SEQ ID NO: 154434
  derived and/or modified sequence opt4 from hemagglutinin__InfluenzaA__ABX58382

SEQ ID NO: 154740 - RNA, 1698 nt, Artificial Sequence; identical to SEQ ID NO: 154575
  derived and/or modified sequence opt4 from hemagglutinin__InfluenzaA__ABX58393

SEQ ID NO: 154741 - RNA, 1698 nt, Artificial Sequence; identical to SEQ ID NO: 154434
  derived and/or modified sequence opt4 from hemagglutinin__InfluenzaA__ABX58404

SEQ ID NO: 154742 - RNA, 1698 nt, Artificial Sequence
  derived and/or modified sequence opt4 from hemagglutinin__InfluenzaA__ABX58415
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagacacaacggcaagcugugccugcugaagggcaucgccccccugcagcugggcaacugcagcguggccggcuggauccugggcaaccccgagugcgagcugcugaucagcaagaagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcagaagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154743 - RNA, 1698 nt, Artificial Sequence; identical to SEQ ID NO: 154434
  derived and/or modified sequence opt4 from hemagglutinin__InfluenzaA__ABX58426

SEQ ID NO: 154744 - RNA, 1698 nt, Artificial Sequence; identical to SEQ ID NO: 154434
  derived and/or modified sequence opt4 from hemagglutinin__InfluenzaA__ABX58437

SEQ ID NO: 154745 - RNA, 1698 nt, Artificial Sequence; identical to SEQ ID NO: 154430
  derived and/or modified sequence opt4 from hemagglutinin__InfluenzaA__ABX58448

SEQ ID NO: 154746 - RNA, 1698 nt, Artificial Sequence; identical to SEQ ID NO: 154476
  derived and/or modified sequence opt4 from hemagglutinin__InfluenzaA__ABX58459

SEQ ID NO: 154747 - RNA, 1698 nt, Artificial Sequence; identical to SEQ ID NO: 154575
  derived and/or modified sequence opt4 from hemagglutinin__InfluenzaA__ABX58470

SEQ ID NO: 154748 - RNA, 1698 nt, Artificial Sequence; identical to SEQ ID NO: 154476
  derived and/or modified sequence opt4 from hemagglutinin__InfluenzaA__ABX58481

SEQ ID NO: 154749 - RNA, 1698 nt, Artificial Sequence; identical to SEQ ID NO: 154434
  derived and/or modified sequence opt4 from hemagglutinin__InfluenzaA__ABX58492

SEQ ID NO: 154750 - RNA, 1698 nt, Artificial Sequence; identical to SEQ ID NO: 154450
  derived and/or modified sequence opt4 from hemagglutinin__InfluenzaA__ABX58503

SEQ ID NO: 154751 - RNA, 1698 nt, Artificial Sequence; identical to SEQ ID NO: 154476
  derived and/or modified sequence opt4 from hemagglutinin__InfluenzaA__ABX58525

SEQ ID NO: 154752 - RNA, 1698 nt, Artificial Sequence
  derived and/or modified sequence opt4 from hemagglutinin__InfluenzaA__ABX58536
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagacacaacggcaagcugugccugcugaagggcaucgccccccugcagcugggcaacugcagcguggccggcuggauccugggcaaccccgagugcgagcugcugaucagcaaggagcccuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcagaagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154753 - RNA, 1698 nt, Artificial Sequence
  derived and/or modified sequence opt4 from hemagglutinin__InfluenzaA__ABX58547
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagaccagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154754 - RNA, 1698 nt, Artificial Sequence
  derived and/or modified sequence opt4 from hemagglutinin__InfluenzaA__ABX58558
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcagaagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacaagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154755 - RNA, 1698 nt, Artificial Sequence
  derived and/or modified sequence opt4 from hemagglutinin__InfluenzaA__ABX58569
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgccaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154756 - RNA, 1698 nt, Artificial Sequence; identical to SEQ ID NO: 154430
  derived and/or modified sequence opt4 from hemagglutinin__InfluenzaA__ABX58580

SEQ ID NO: 154757 - RNA, 1698 nt, Artificial Sequence; identical to SEQ ID NO: 154434
  derived and/or modified sequence opt4 from hemagglutinin__InfluenzaA__ABX58591

SEQ ID NO: 154758 - RNA, 1698 nt, Artificial Sequence
  derived and/or modified sequence opt4 from hemagglutinin__InfluenzaA__ABX58602
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcuggagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccagagacaccaucaucuucgaggccaacggcaaccugaucgcccccagauucgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154759 - RNA, 1698 nt, Artificial Sequence; identical to SEQ ID NO: 154467
  derived and/or modified sequence opt4 from hemagglutinin__InfluenzaA__ABX58613

SEQ ID NO: 154760 - RNA, 1698 nt, Artificial Sequence; identical to SEQ ID NO: 154434
  derived and/or modified sequence opt4 from hemagglutinin__InfluenzaA__ABX58624

SEQ ID NO: 154761 - RNA, 1698 nt, Artificial Sequence
  derived and/or modified sequence opt4 from hemagglutinin__InfluenzaA__ABX58635
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcagaagcagcuucuacagaaaccugcuguggcugaccggcaagaacggccuguaccccagccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154762 - RNA, 1698 nt, Artificial Sequence; identical to SEQ ID NO: 154430
  derived and/or modified sequence opt4 from hemagglutinin__InfluenzaA__ABX58679

SEQ ID NO: 154763 - RNA, 1698 nt, Artificial Sequence; identical to SEQ ID NO: 154476
  derived and/or modified sequence opt4 from hemagglutinin__InfluenzaA__ABX58701

SEQ ID NO: 154764 - RNA, 1698 nt, Artificial Sequence; identical to SEQ ID NO: 154534
  derived and/or modified sequence opt4 from hemagglutinin__InfluenzaA__ABX58712

SEQ ID NO: 154765 - RNA, 1704 nt, Artificial Sequence
  derived and/or modified sequence opt4 from hemagglutinin__InfluenzaA__ABY19417
auggagaagaucgugcugcugcuggccaucaucagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcgugcccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucaaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucagaaucuga

SEQ ID NO: 154766 - RNA, 1704 nt, Artificial Sequence
  derived and/or modified sequence opt4 from hemagglutinin__InfluenzaA__ABY19418
auggagaagaucgugcugcugcuggccaucaucagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcgacuucaacgacuacgaggagcugaagcaccugcugagcagaaucaaccacuucgagaagauccagaucauccccaagagcagcuggagcgaccacgaggccagcagcggcgugagcagcgccugccccuaccagggcgugcccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuuccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 154767 - RNA, 1704 nt, Artificial Sequence
  derived and/or modified sequence opt4 from hemagglutinin__InfluenzaA__ABY19419
auggagaagaucgugcugcugcuggccaucaucagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcgugcccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 154768 - RNA, 1698 nt, Artificial Sequence; identical to SEQ ID NO: 154575
  derived and/or modified sequence opt4 from hemagglutinin__InfluenzaA__ABY51017

SEQ ID NO: 154769 - RNA, 1701 nt, Artificial Sequence; identical to SEQ ID NO: 154448
  derived and/or modified sequence opt4 from hemagglutinin__InfluenzaA__ABY51028

SEQ ID NO: 154770 - RNA, 1698 nt, Artificial Sequence
  derived and/or modified sequence opt4 from hemagglutinin__InfluenzaA__ABY51039
augaaggugaagcugcuggugcugcugugcaccuucaccgccaccaacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagggccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154771 - RNA, 1698 nt, Artificial Sequence
  derived and/or modified sequence opt4 from hemagglutinin__InfluenzaA__ABY51050
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacagcaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154772 - RNA, 1698 nt, Artificial Sequence; identical to SEQ ID NO: 154534
  derived and/or modified sequence opt4 from hemagglutinin__InfluenzaA__ABY51061

SEQ ID NO: 154773 - RNA, 1698 nt, Artificial Sequence
  derived and/or modified sequence opt4 from hemagglutinin__InfluenzaA__ABY51072
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggccuucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154774 - RNA, 1698 nt, Artificial Sequence; identical to SEQ ID NO: 154476
  derived and/or modified sequence opt4 from hemagglutinin__InfluenzaA__ABY51083

SEQ ID NO: 154775 - RNA, 1698 nt, Artificial Sequence; identical to SEQ ID NO: 154434
  derived and/or modified sequence opt4 from hemagglutinin__InfluenzaA__ABY51094

SEQ ID NO: 154776 - RNA, 1698 nt, Artificial Sequence; identical to SEQ ID NO: 154575
  derived and/or modified sequence opt4 from hemagglutinin__InfluenzaA__ABY51105

SEQ ID NO: 154777 - RNA, 1698 nt, Artificial Sequence; identical to SEQ ID NO: 154434
  derived and/or modified sequence opt4 from hemagglutinin__InfluenzaA__ABY51116

SEQ ID NO: 154778 - RNA, 1701 nt, Artificial Sequence
  derived and/or modified sequence opt4 from hemagglutinin__InfluenzaA__ABY51127
augaagaccaucaucgcccugagcuacauccugugcaugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagguguuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154779 - RNA, 1698 nt, Artificial Sequence
  derived and/or modified sequence opt4 from hemagglutinin__InfluenzaA__ABY51138
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagacacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcagaagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagauccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154780 - RNA, 1698 nt, Artificial Sequence; identical to SEQ ID NO: 154434
  derived and/or modified sequence opt4 from hemagglutinin__InfluenzaA__ABY51149

SEQ ID NO: 154781 - RNA, 1698 nt, Artificial Sequence
  derived and/or modified sequence opt4 from hemagglutinin__InfluenzaA__ABY51160
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagacacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154782 - RNA, 1698 nt, Artificial Sequence
  derived and/or modified sequence opt4 from hemagglutinin__InfluenzaA__ABY51171
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccagaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154783 - RNA, 1698 nt, Artificial Sequence; identical to SEQ ID NO: 154430
  derived and/or modified sequence opt4 from hemagglutinin__InfluenzaA__ABY51182

SEQ ID NO: 154784 - RNA, 1698 nt, Artificial Sequence; identical to SEQ ID NO: 154450
  derived and/or modified sequence opt4 from hemagglutinin__InfluenzaA__ABY51193

SEQ ID NO: 154785 - RNA, 1698 nt, Artificial Sequence; identical to SEQ ID NO: 154434
  derived and/or modified sequence opt4 from hemagglutinin__InfluenzaA__ABY51237

SEQ ID NO: 154786 - RNA, 1698 nt, Artificial Sequence; identical to SEQ ID NO: 154450
  derived and/or modified sequence opt4 from hemagglutinin__InfluenzaA__ABY51248

SEQ ID NO: 154787 - RNA, 1698 nt, Artificial Sequence; identical to SEQ ID NO: 154430
  derived and/or modified sequence opt4 from hemagglutinin__InfluenzaA__ABY51259

SEQ ID NO: 154788 - RNA, 1701 nt, Artificial Sequence; identical to SEQ ID NO: 154507
  derived and/or modified sequence opt4 from hemagglutinin__InfluenzaA__ABY51270

SEQ ID NO: 154789 - RNA, 1707 nt, Artificial Sequence
  derived and/or modified sequence opt4 from hemagglutinin__InfluenzaA__ABY76282
auggagaagaucgugcugcugcuggccaucgugagccuggugaagagcgaccagaucugcaucggcuaccacgccaacaacagcaccgagcacguggacaccaucauggagaagaacgugaccgugacccacgcccaggacauccuggagaaggcccacaacggcagacugugcgaccuggacggcgugaagccccugauccugagagacugcagcguggccggcuggcugcugggcaaccccaugugcgacgaguuccugaacgugcccgaguggagcuacaucguggagaagaacaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaagaacgacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 154790 - RNA, 1701 nt, Artificial Sequence
  derived and/or modified sequence opt4 from hemagglutinin__InfluenzaA__ABY81349
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagaagcuggcccaagcacaacgugaccagaggcgugaccgccgccugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucaaggaccagaagaccaucuaccagaaggagaacgccuacgugagcguggugagcagcaacuacaacagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacaccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggaggugggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154791 - RNA, 1701 nt, Artificial Sequence; identical to SEQ ID NO: 154448
  derived and/or modified sequence opt4 from hemagglutinin__InfluenzaA__ABY81371

SEQ ID NO: 154792 - RNA, 1698 nt, Artificial Sequence; identical to SEQ ID NO: 154434
  derived and/or modified sequence opt4 from hemagglutinin__InfluenzaA__ABY81382

SEQ ID NO: 154793 - RNA, 1698 nt, Artificial Sequence; identical to SEQ ID NO: 154476
  derived and/or modified sequence opt4 from hemagglutinin__InfluenzaA__ABY81393

SEQ ID NO: 154794 - RNA, 1698 nt, Artificial Sequence
  derived and/or modified sequence opt4 from hemagglutinin__InfluenzaA__ABY81415
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccagccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154795 - RNA, 1701 nt, Artificial Sequence; identical to SEQ ID NO: 154448
  derived and/or modified sequence opt4 from hemagglutinin__InfluenzaA__ACA24502

SEQ ID NO: 154796 - RNA, 1698 nt, Artificial Sequence
  derived and/or modified sequence opt4 from hemagglutinin__InfluenzaA__ACA24513
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugaacagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccagagacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154797 - RNA, 1698 nt, Artificial Sequence; identical to SEQ ID NO: 154434
  derived and/or modified sequence opt4 from hemagglutinin__InfluenzaA__ACA24524

SEQ ID NO: 154798 - RNA, 1701 nt, Artificial Sequence
  derived and/or modified sequence opt4 from hemagglutinin__InfluenzaA__ACA24689
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagaucaucgacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacuacguguacagagacgaggcccugaacaacagauuccagaucaagggcaucgagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154799 - RNA, 1701 nt, Artificial Sequence
  derived and/or modified sequence opt4 from hemagglutinin__InfluenzaA__ACA24700
augaagaccaucaucgcccugagcuacauccugugccugguguucgcccagaagcugcccggcaucgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagccaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154800 - RNA, 1698 nt, Artificial Sequence
  derived and/or modified sequence opt4 from hemagglutinin__InfluenzaA__ACA28846
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcauccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154801 - RNA, 1701 nt, Artificial Sequence
  derived and/or modified sequence opt4 from hemagglutinin__InfluenzaA__ACA33749
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcagcugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154802 - RNA, 1698 nt, Artificial Sequence; identical to SEQ ID NO: 154430
  derived and/or modified sequence opt4 from hemagglutinin__InfluenzaA__ACA96519

SEQ ID NO: 154803 - RNA, 1659 nt, Artificial Sequence
  derived and/or modified sequence opt4 from hemagglutinin__InfluenzaA__ACC55270
augaacacccagauccuggccuucaucgccugcgugcugaccggcgugaagggcgacaagaucugccugggccaccacgccguggccaacggcaccaaggugaacacccugaccgagagaggcaucgagguggugaacgccaccgagaccguggagaccaccaacaucaagaagaucugcacccagggcaagagacccaccgaccugggccagugcggccugcugggcacccugaucggccccccccagugcgaccaguuccuggaguucagcagcgaccugaucaucgagagaagagagggcaccgacaucugcuaccccggcagauucaccaacgaggagagccugagacagauccugagaagaagcggcggcaucggcaaggagagcaugggcuucaccuacagcggcaucagaaccaacggcgccaccagcgccugcaccagaagcggcagcagcuucuacgccgagaugaaguggcugcugagcaacagcgacaacgccgccuucccccagaugaccaaggccuacagaaaccccagaaacaagcccgcccugaucaucuggggcgugcaccacagcgagagcgugagcgagcagaccaagcuguacggcagcggcaacaagcugaucaccgugagaagcagcaaguaccagcagagcuucacccccaaccccggcgccagaagaaucgacuuccacuggcugcugcuggaccccaacgacaccgugaccuucaccuucaacggcgccuucaucgcccccgacagaaccagcuucuucagaggcgagagccugggcgugcagagcgacgccccccuggacagcagcugcagaggcgacugcuuccacagcggcggcaccaucgugagcagccugcccuuccagaacaucaacagcagaaccgugggcaagugccccagauacgugaagcagaagagccugcugcuggccaccggcaugagaaacgugcccgagaagcccaagcccagaggccuguucggcgccaucgccggcuucaucgagaacggcugggagggccugaucaacggcugguacggcuucagacaccagaacgcccagggcgagggcaccgccgccgacuacaagagcacccagagcgccaucgaccagaucaccggcaagcugaacagacugaucggcaagaccaaccagcaguucgagcugaucgacaacgaguucaacgagaucgagcagcagaucggcaacgugaucaacuggaccagagacgccaugaccgagaucuggagcuacaacgccgagcugcugguggccauggagaaccagcacaccaucgaccuggccgacagcgagaugagcaagcuguacgagagagugaagaagcagcugagagagaacgccgaggaggacggcaccggcugcuucgagaucuuccacaagugcgacgaccagugcauggagagcaucagaaacaacaccuacgaccacacccaguacagaaccgagagccugcagaacagaauccagaucgaccccgugaagcugagcagcggcuacaaggacaucauccugugguucagcuucggcgccagcugcuuccugcugcuggccaucgccaugggccugguguucaucugcaucaagaacggcaacaugcagugcaccaucugcaucuga

SEQ ID NO: 154804 - RNA, 1698 nt, Artificial Sequence; identical to SEQ ID NO: 154434
  derived and/or modified sequence opt4 from hemagglutinin__InfluenzaA__ACC61964

SEQ ID NO: 154805 - RNA, 1698 nt, Artificial Sequence
  derived and/or modified sequence opt4 from hemagglutinin__InfluenzaA__ACC61975
augaaggugaagcugcuggugcugcugugcaccuucaccgccagcuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggaggugcccaaccccgagaacggcaccugcuaccccggcuacuucgccgacuacgaggagcugagagagcagcugagcagcaucagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggccugggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154806 - RNA, 1698 nt, Artificial Sequence; identical to SEQ ID NO: 154430
  derived and/or modified sequence opt4 from hemagglutinin__InfluenzaA__ACC61986

SEQ ID NO: 154807 - RNA, 1698 nt, Artificial Sequence
  derived and/or modified sequence opt4 from hemagglutinin__InfluenzaA__ACD37430
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccacccacaccgugaccggcgugagcgccagcugcagccacaacggcaagagcagcuucuacagaaaccugcuguggcugaccggcaagaacggccuguaccccaaccugagcaagagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154808 - RNA, 1698 nt, Artificial Sequence
  derived and/or modified sequence opt4 from hemagglutinin__InfluenzaA__ACD37507
augaaggccaagcugcuggugcugcugugcaccuucgccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154809 - RNA, 1698 nt, Artificial Sequence; identical to SEQ ID NO: 154575
  derived and/or modified sequence opt4 from hemagglutinin__InfluenzaA__ACD56113

SEQ ID NO: 154810 - RNA, 1698 nt, Artificial Sequence; identical to SEQ ID NO: 154434
  derived and/or modified sequence opt4 from hemagglutinin__InfluenzaA__ACD56124

SEQ ID NO: 154811 - RNA, 1701 nt, Artificial Sequence; identical to SEQ ID NO: 154507
  derived and/or modified sequence opt4 from hemagglutinin__InfluenzaA__ACD56258

SEQ ID NO: 154812 - RNA, 1701 nt, Artificial Sequence; identical to SEQ ID NO: 154249
  derived and/or modified sequence opt4 from hemagglutinin__InfluenzaA__ACD56269

SEQ ID NO: 154813 - RNA, 1698 nt, Artificial Sequence
  derived and/or modified sequence opt4 from hemagglutinin__InfluenzaA__ACD56280
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccggcaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgaggccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154814 - RNA, 1689 nt, Artificial Sequence
  derived and/or modified sequence opt4 from hemagglutinin__InfluenzaA__ACD56324
auggccaucaucuaccugauccugcuguucaccgccgugagaggcgaccagaucugcaucggcuaccacgccaacaacagcaccgagaagguggacaccauccuggagagaaacgugaccgugacccacgccaagaacauccuggagaagacccacaacggcagacugugcaagcugaacggcauccccccccuggagcugggcgacugcagcaucgccggcuggcugcugggcaaccccgagugcgacagacugcugagagugcccgaguggagcuacaucauggagaaggagaaccccagaaacggccugugcuaccccggcagcuucaacgacuacgaggagcugaagcaccugcugagcagcgugaagcacuucgagaaggugagaauccugcccaaggacagauggacccagcacaccaccaccggcagcagcagagccugcgccgugagcggcaaccccagcuucuucagaaacaugguguggcugaccaagaaggagagcaacuaccccguggccaagggcagcuacaacaacaccagcggcgagcagaugcugaucaucuggggcgugcaccaccccaucgacgagaccgagcagagaacccuguaccagaacgugggcaccuacgugagcgugggcaccagcacccugaacaagagaagcacccccgacaucgccaccagacccaaggugaacggccugggcagcagaauggaguucagcuggacccugcuggacaugugggacaccaucaacuucgagagcaccggcaaccugaucgcccccgaguacggcuucaagaucagcaagagaggcagcagcggcaucaugaagaccgagagaacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagcccagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 154815 - RNA, 1689 nt, Artificial Sequence
  derived and/or modified sequence opt4 from hemagglutinin__InfluenzaA__ACD85187
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacagccugugcuaccccggcagcuucaacgacuacgaggagcugaagcaccugcugagcagcgugaagcacuucgagaaggugaagauccugcccaaggacagauggacccagcacaccaccaccggcggcagcaaggccugcgccgugagcggcaagcccagcuucuucagaaacaugguguggcugaccaagaagggccccaacuaccccguggccaagggcagcuacaacaacaccagcggcgagcagaugcugaucaucuggggcgugcaccaccccaaggacgaggccgagcagagagcccuguaccaggaggugggcaccuacgugagcgccagcaccagcacccugaacaagagaagcacccccgagaucgccgccagacccgaggugaacggccugggcagcagaauggaguucagcuggacccugcuggacgugugggacaccaucaacuucgagagcaccggcaaccugguggcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucaacaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 154816 - RNA, 1689 nt, Artificial Sequence
  derived and/or modified sequence opt4 from hemagglutinin__InfluenzaA__ACD85198
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacagccugugcuaccccggcagcuucaacgacuacgaggagcugaagcaccugcugagcagcgugaagcacuucgagaaggugaagauccugcccaaggacggcuggacccagcacaccaccaccggcggcagcaaggccugcgccgugagcggcaagcccagcuucuucagaaacaugguguggcugaccaagaagggccccaacuaccccguggccaagagaagcuacaacaacaccagcggcgagcagaugcugaucaucuggggcgugcaccaccccaccgacgaggccgagcagagagcccuguaccaggaggugggcaccuacgugagcgccagcaccagcacccugaacaagagaagcacccccgagaucgccgccagacccgaggugaacggccugagaagcagaauggaguucagcuggacccugcuggacgugugggacaccaucaacuucgagagcaccggcaaccugguggcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacagaaucaccaacaaggugaacagcgugaucgagaagaugaacacccaguucgaggccgugggcaaggaguucagcaaccuggagaagagacuggagaaccugaacaagaagauggaggacggcuuccuggacguguggaccuacaacgccgagcugcuggugcugauggagaacgagagaacccugggcuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaagagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 154817 - RNA, 1689 nt, Artificial Sequence
  derived and/or modified sequence opt4 from hemagglutinin__InfluenzaA__ACD85209
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugacccagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgacaucgccaccagacccaaggugaacggccagggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 154818 - RNA, 1689 nt, Artificial Sequence
  derived and/or modified sequence opt4 from hemagglutinin__InfluenzaA__ACD85220
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccaaguacagccugugcuaccccggcagcuucaacgacuacgaggagcugaagcaccugcugagcagcgugaagcacuucgagaaggugaagauccugcccaaggacagauggacccagcacaccaccaccggcggcagcaaggccugcgccgugagcggcgagcccagcuucuucagaaacaugguguggcugaccaagaagggccccaacuaccccguggccaagggcagcuacaacaacaccagcggcgagcagaugcugaucaucuggggcgugcaccaccccaaggacgaggccgagcagagagcccuguaccagaacgugggcaccuacgugagcgccagcaccagcacccugaacaagagaagcacccccgagaucgccgccagacccgaggugaacggccugggcagcagaauggaguucagcuggacccugcuggacgugugggacaccaucaacuucgagagcaccggcaaccugguggcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucaacaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgagaaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 154819 - RNA, 1689 nt, Artificial Sequence
  derived and/or modified sequence opt4 from hemagglutinin__InfluenzaA__ACD85242
auggccaucaucuaccugauccugcuguucgccaccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacagccugugcuaccccggcagccugaacgacuacgaggagcugaagcaccugcugagcagcgugaagcacuucgagaaggugagaauccugcccaaggacagauggacccagcacaccaccaccggcggcagcaaggccugcgccgugagcggcaagcccagcuucuucagaaacaugguguggcugaccaagaagggccccaacuaccccguggccaagggcagcuacaacaacaccagcggcgagcagaugcugaucaucuggggcgugcaccaccccaaggacgaggccgagcagagagcccuguaccaggaggugggcaccuacgugagcgccagcaccagcacccugaacaagagaagcauccccgagaucgccgccagacccgaggugaacggccugggcagcagaauggaguucagcuggacccugcuggacgugugggacaccaucaacuucgagagcaccggcaaccugguggcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcaugaucgagaagaugaacacccaguucgaggccgugggcaaggaguucaacaaccuggagaagagacuggagaaccuggacaagaagauggaggacggcuuccuggacguguggaccuacaacgccgagcugcuggugcugauggagaacgagagaacccuggacuuccacgacagcaacgugaagaaccuguacgagaaggugagaaugcagcugagagacaacgugaaggagcugggcaacggcugcuucgaguucuaccacaagugcgacaacgagugcaugaacagcgugaagaacggcaccuacgacuaccccaaguacgaggaggagagcaagcugaagagaaacgagaucaagggcgugaagcugagcagcaugggcguguaccagauccuggccaucuacgccaccguggccggcagccugagccuggccaucaugguggccggcaucagcuucuggaugugcagcaacggcagccugcagugcagaaucugcaucuga

SEQ ID NO: 154820 - RNA, 1689 nt, Artificial Sequence
  derived and/or modified sequence opt4 from hemagglutinin__InfluenzaA__ACD85253
auggccaucaucuaccugauccugcuguucgccaccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacaaccugugcuaccccggcagccugaacgaguacgaggagcugaagcaccugcugagcagcgugaagcacuucgagaaggugagaauccugcccaaggacagauggacccagcacaccaccaccggcggcagcaaggccugcgccgugagcggcgagcccagcuucuucagaaacaugguguggcugaccaagaagggccccaacuaccccguggccaagggcagcuacaacaacaccagcggcgagcagaugcugaucaucuggggcgugcaccaccccaacgacgaggccgagcagagagcccuguaccagaaggugggcaccuacgugagcgccagcaccagcacccugaacaagagaagcauccccgagaucgccgccagacccaaggugaacggccugggcagcagaauggaguucuucuggacccugcuggacgugugggacaccaucaacuucgagagcaccggcaaccugguggugcccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgagaccgugggcaaggaguucaacaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgagaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaagagaaacgagaucaagggcgugaagcugagcagcaugggcguguaccagauccuggccaucuacgccaccguggccggcagccugagccuggccaucaugguggccggcaucagcuucuggaugugcagcaacggcagccugcagugcagaaucugcaucuga

SEQ ID NO: 154821 - RNA, 1701 nt, Artificial Sequence
  derived and/or modified sequence opt4 from hemagglutinin__InfluenzaA__ACD85440
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggaccugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154822 - RNA, 1701 nt, Artificial Sequence; identical to SEQ ID NO: 154821
  derived and/or modified sequence opt4 from hemagglutinin__InfluenzaA__ACD85451

SEQ ID NO: 154823 - RNA, 1701 nt, Artificial Sequence; identical to SEQ ID NO: 154821
  derived and/or modified sequence opt4 from hemagglutinin__InfluenzaA__ACD85462

SEQ ID NO: 154824 - RNA, 1701 nt, Artificial Sequence; identical to SEQ ID NO: 154448
  derived and/or modified sequence opt4 from hemagglutinin__InfluenzaA__ACD85473

SEQ ID NO: 154825 - RNA, 1701 nt, Artificial Sequence
  derived and/or modified sequence opt4 from hemagglutinin__InfluenzaA__ACD85484
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154826 - RNA, 1701 nt, Artificial Sequence; identical to SEQ ID NO: 154448
  derived and/or modified sequence opt4 from hemagglutinin__InfluenzaA__ACD85495

SEQ ID NO: 154827 - RNA, 1701 nt, Artificial Sequence
  derived and/or modified sequence opt4 from hemagglutinin__InfluenzaA__ACD85528
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgugagccugagaagccugguggccagcagcggcacccuggaguucaacaacgagagcuucaacuggaccggcgugacccagaacggcaccagcagcgccugcaucagaagaagcaacaagagcuucuucagcagacugaacuggcugacccaccugaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggaccugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154828 - RNA, 1701 nt, Artificial Sequence
  derived and/or modified sequence opt4 from hemagglutinin__InfluenzaA__ACD85539
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaaccaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154829 - RNA, 1701 nt, Artificial Sequence
  derived and/or modified sequence opt4 from hemagglutinin__InfluenzaA__ACD85550
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggaccugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccugcugugcguggcccugcugggcuucaucaugugggccugccagaagggcaacaucagaugcaacaucugcaucuga

SEQ ID NO: 154830 - RNA, 1701 nt, Artificial Sequence; identical to SEQ ID NO: 154448
  derived and/or modified sequence opt4 from hemagglutinin__InfluenzaA__ACD85561

SEQ ID NO: 154831 - RNA, 1701 nt, Artificial Sequence
  derived and/or modified sequence opt4 from hemagglutinin__InfluenzaA__ACD85572
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaccggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154832 - RNA, 1701 nt, Artificial Sequence; identical to SEQ ID NO: 154828
  derived and/or modified sequence opt4 from hemagglutinin__InfluenzaA__ACD85583

SEQ ID NO: 154833 - RNA, 1701 nt, Artificial Sequence
  derived and/or modified sequence opt4 from hemagglutinin__InfluenzaA__ACD93579
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacaccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154834 - RNA, 1701 nt, Artificial Sequence; identical to SEQ ID NO: 153150
  derived and/or modified sequence opt4 from hemagglutinin__InfluenzaA__ACF09402

SEQ ID NO: 154835 - RNA, 1701 nt, Artificial Sequence
  derived and/or modified sequence opt4 from hemagglutinin__InfluenzaA__ACF22159
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcuucagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154836 - RNA, 1701 nt, Artificial Sequence
  derived and/or modified sequence opt4 from hemagglutinin__InfluenzaA__ACF22188
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucuggagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaacuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154837 - RNA, 1701 nt, Artificial Sequence; identical to SEQ ID NO: 154836
  derived and/or modified sequence opt4 from hemagglutinin__InfluenzaA__ACF22199

SEQ ID NO: 154838 - RNA, 1701 nt, Artificial Sequence
  derived and/or modified sequence opt4 from hemagglutinin__InfluenzaA__ACF22210
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154839 - RNA, 1701 nt, Artificial Sequence; identical to SEQ ID NO: 154838
  derived and/or modified sequence opt4 from hemagglutinin__InfluenzaA__ACF22221

SEQ ID NO: 154840 - RNA, 1701 nt, Artificial Sequence; identical to SEQ ID NO: 154838
  derived and/or modified sequence opt4 from hemagglutinin__InfluenzaA__ACF22232

SEQ ID NO: 154841 - RNA, 1701 nt, Artificial Sequence; identical to SEQ ID NO: 154838
  derived and/or modified sequence opt4 from hemagglutinin__InfluenzaA__ACF22243

SEQ ID NO: 154842 - RNA, 1701 nt, Artificial Sequence; identical to SEQ ID NO: 154838
  derived and/or modified sequence opt4 from hemagglutinin__InfluenzaA__ACF22254

SEQ ID NO: 154843 - RNA, 1701 nt, Artificial Sequence; identical to SEQ ID NO: 154838
  derived and/or modified sequence opt4 from hemagglutinin__InfluenzaA__ACF22265

SEQ ID NO: 154844 - RNA, 1701 nt, Artificial Sequence; identical to SEQ ID NO: 154838
  derived and/or modified sequence opt4 from hemagglutinin__InfluenzaA__ACF22276

SEQ ID NO: 154845 - RNA, 1701 nt, Artificial Sequence; identical to SEQ ID NO: 154838
  derived and/or modified sequence opt4 from hemagglutinin__InfluenzaA__ACF22287

SEQ ID NO: 154846 - RNA, 1701 nt, Artificial Sequence; identical to SEQ ID NO: 154838
  derived and/or modified sequence opt4 from hemagglutinin__InfluenzaA__ACF22298

SEQ ID NO: 154847 - RNA, 1701 nt, Artificial Sequence; identical to SEQ ID NO: 154838
  derived and/or modified sequence opt4 from hemagglutinin__InfluenzaA__ACF22320

SEQ ID NO: 154848 - RNA, 1701 nt, Artificial Sequence; identical to SEQ ID NO: 154838
  derived and/or modified sequence opt4 from hemagglutinin__InfluenzaA__ACF22342

SEQ ID NO: 154849 - RNA, 1701 nt, Artificial Sequence
  derived and/or modified sequence opt4 from hemagglutinin__InfluenzaA__ACF22364
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucgagagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154850 - RNA, 1701 nt, Artificial Sequence; identical to SEQ ID NO: 154828
  derived and/or modified sequence opt4 from hemagglutinin__InfluenzaA__ACF22408

SEQ ID NO: 154851 - RNA, 1701 nt, Artificial Sequence; identical to SEQ ID NO: 154448
  derived and/or modified sequence opt4 from hemagglutinin__InfluenzaA__ACF41669

SEQ ID NO: 154852 - RNA, 1698 nt, Artificial Sequence; identical to SEQ ID NO: 154434
  derived and/or modified sequence opt4 from hemagglutinin__InfluenzaA__ACF41680

SEQ ID NO: 154853 - RNA, 1689 nt, Artificial Sequence
  derived and/or modified sequence opt4 from hemagglutinin__InfluenzaA__ACF41691
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacagccugugcuaccccggcagcuucaacgacuacgaggagcugaagcaccugcugagcagcgugaagcacuucgagaaggugaagauccugcccaaggacggcuggacccagcacgagaccgacggcggcagcaaggccugcgccgugagcggcaagcccagcuucuucagaaacaugguguggcugaccaagaagggccccaacuaccccguggccaagagaagcuacaacaacaccagcggcgagcagaugcugaucaucuggggcgugcaccaccccaacgacgaggccgagcagagagcccuguaccaggaggugggcaccuacgugagcgccagcaccagcacccugaacaagagaagcacccccgagaucgccgccagacccaaggugagcggccugggcagcagaauggaguucagcuggacccugcuggacgugugggacaccaucagcuucgagagcaccggcaaccugguggcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacagaaucaccaacaaggugaacagcgugaucgagaagaugaacacccaguucgaggccgugggcaaggaguucagcaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaagagaaacgagaucaagggcguggagcugagcagcaugggcguguaccagauccuggccaucuacgccaccguggccggcagccugagccuggccaucaugaucgccggcaucagcuucuggaugugcagcaacggcagccugcagugcagaaucugcaucuga

SEQ ID NO: 154854 - RNA, 1701 nt, Artificial Sequence; identical to SEQ ID NO: 154836
  derived and/or modified sequence opt4 from hemagglutinin__InfluenzaA__ACF41735

SEQ ID NO: 154855 - RNA, 1701 nt, Artificial Sequence
  derived and/or modified sequence opt4 from hemagglutinin__InfluenzaA__ACF41790
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgaggacuucaccuggaccggcgugacccagaacggcggcagcaacgccugcaagagaggccccggcagcggcuucuucagcagacugaacuggcugaccaagagcggcagcaccuaccccgugcuggacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154856 - RNA, 1701 nt, Artificial Sequence
  derived and/or modified sequence opt4 from hemagglutinin__InfluenzaA__ACF41823
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagcagacagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154857 - RNA, 1698 nt, Artificial Sequence
  derived and/or modified sequence opt4 from hemagglutinin__InfluenzaA__ACF41834
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccccaaccugaagaacagcuacgugaacaagaagggcaaggaggugcuggugcuguggggcauccaccaccccagcaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 154858 - RNA, 1701 nt, Artificial Sequence
  derived and/or modified sequence opt4 from hemagglutinin__InfluenzaA__ACF41856
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcaagagaggcagcgugaacagcuucuucagcagacugaacuggcugcacaagagcgaguacaaguaccccgcccugaacgugaccaugcccaacaacggcaaguucgacaagcuguacaucuggggcgugcaccaccccagcaccgacagagaccagaccagccuguacgugagagccagcggcagagugaccgugagcaccaagagaagccagcagaccgugacccccaacaucggcagcagacccugggugagaggccagagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154859 - RNA, 1698 nt, Artificial Sequence
  derived and/or modified sequence opt4 from hemagglutinin__InfluenzaA__ACF41867
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugaccgccagcugcagccacaacggcaagagcagcuucuacagaaaccugcuguggcugaccgagaagaacggccuguaccccaaccugagcaacagcuacgugaacaacaaggagaaggaggugcuggugcuguggggcgugcaccaccccagcaacaucagagaccagagagccaucuaccacaccgagaacgccuacgugagcguggugagcagccacuacagcagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugaacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugauggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154860 - RNA, 1698 nt, Artificial Sequence; identical to SEQ ID NO: 154635
  derived and/or modified sequence opt4 from hemagglutinin__InfluenzaA__ACF41878

SEQ ID NO: 154861 - RNA, 1701 nt, Artificial Sequence
  derived and/or modified sequence opt4 from hemagglutinin__InfluenzaA__ACF41922
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcguggccggcuggauccugggcaaccccaagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacagaaaccugcuguggcugaccgagaagaacggccuguaccccaaccugagcaagagcuacgugaacaacaaggagaaggaggugcuggugcuguggggcgugcaccaccccagcaacaucagagaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacggcagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagaggcaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154862 - RNA, 1689 nt, Artificial Sequence
  derived and/or modified sequence opt4 from hemagglutinin__InfluenzaA__ACF54389
auggccaucaucuaccugauccugcuguucgccaccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacagccugugcuaccccggcagccugaacgacuacgaggagcugaagcaccugcugagcagcgugaagcacuucgagaaggugagaauccugcccaaggacagauggacccagcacaccaccaccggcggcagcaaggccugcgccgugagcggcaagcccagcuucuucagaaacaugguguggcugaccaagaagggcaccaacuaccccguggccaagggcagcuacaacaacaccagcggcgagcagaugcugaucaucuggggcgugcaccaccccaucgacgaggccgagcagagagcccuguaccaggaggugggcaccuacgugagcgccagcaccagcacccugaacaagagaagcauccccgagaucgccgccagacccgaggugaacggccugggcagcagaauggaguucagcuggacccugcuggacgugugggacaccaucaacuucgagagcaccggcaaccugguggcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgagcagggcagcggcuacgccgccgacaaggagagcacccagaaggccuucgacggcaucaccaacaaggugaacagcgugaucgagaagaugaacacccaguucgaggccgugggcaaggaguucaacaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgagaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaagagaaacgagaucaagggcgugaagcugagcagcaugggcguguaccagauccuggccaucuacgccaccguggccggcagccugagccuggccaucaugguggccggcaucagcuucuggaugugcagcaacggcagccugcagugcagaaucugcaucuga

SEQ ID NO: 154863 - RNA, 1701 nt, Artificial Sequence; identical to SEQ ID NO: 154836
  derived and/or modified sequence opt4 from hemagglutinin__InfluenzaA__ACF54400

SEQ ID NO: 154864 - RNA, 1701 nt, Artificial Sequence; identical to SEQ ID NO: 154838
  derived and/or modified sequence opt4 from hemagglutinin__InfluenzaA__ACF54411

SEQ ID NO: 154865 - RNA, 1701 nt, Artificial Sequence; identical to SEQ ID NO: 154838
  derived and/or modified sequence opt4 from hemagglutinin__InfluenzaA__ACF54422

SEQ ID NO: 154866 - RNA, 1701 nt, Artificial Sequence; identical to SEQ ID NO: 154849
  derived and/or modified sequence opt4 from hemagglutinin__InfluenzaA__ACF54433

SEQ ID NO: 154867 - RNA, 1701 nt, Artificial Sequence; identical to SEQ ID NO: 154838
  derived and/or modified sequence opt4 from hemagglutinin__InfluenzaA__ACF54444

SEQ ID NO: 154868 - RNA, 1701 nt, Artificial Sequence; identical to SEQ ID NO: 154856
  derived and/or modified sequence opt4 from hemagglutinin__InfluenzaA__ACF54466

SEQ ID NO: 154869 - RNA, 1689 nt, Artificial Sequence
  derived and/or modified sequence opt4 from hemagglutinin__InfluenzaA__ACF54477
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgacaucgccaccagacccaaggugaacggccugggcagcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 154870 - RNA, 1689 nt, Artificial Sequence
  derived and/or modified sequence opt4 from hemagglutinin__InfluenzaA__ACF54499
auggccaucaucuaccugauccugcuguucaccgccgugagaggcgaccagaucugcaucggcuaccacgccaacaacagcaccgagaccguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgacaucgccaccagacccaaggugaacggccugggcagcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 154871 - RNA, 1689 nt, Artificial Sequence; identical to SEQ ID NO: 154870
  derived and/or modified sequence opt4 from hemagglutinin__InfluenzaA__ACF54510

SEQ ID NO: 154872 - RNA, 1689 nt, Artificial Sequence; identical to SEQ ID NO: 154870
  derived and/or modified sequence opt4 from hemagglutinin__InfluenzaA__ACF54521

SEQ ID NO: 154873 - RNA, 1701 nt, Artificial Sequence
  derived and/or modified sequence opt4 from hemagglutinin__InfluenzaA__ACF54532
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaccagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154874 - RNA, 1701 nt, Artificial Sequence
  derived and/or modified sequence opt4 from hemagglutinin__InfluenzaA__ACF54543
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgugagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggaccugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154875 - RNA, 1701 nt, Artificial Sequence
  derived and/or modified sequence opt4 from hemagglutinin__InfluenzaA__ACF54565
augaagaccaucaucgcccugagcuacauccugugccugguguucagccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccgugaccgacagcgaccagaucagccuguacgcccaggccagcggcagaaucaccgugagcaccaagagaagccagcagaccgugauccccaacaucggcuacagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154876 - RNA, 1701 nt, Artificial Sequence
  derived and/or modified sequence opt4 from hemagglutinin__InfluenzaA__ACF54576
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacgacgagagcuucaacuggaccggcgugacccagaacggcaccagcagcagcugcaagagaagaagcaacaacagcuucuucagcagacugaacuggcugacccagcugaaguucaaguaccccgcccugaacgugaccaugcccaacaacgagaaguucgacaagcuguacaucuggggcgugcaccaccccgugaccgacaacgaccagaucuuccuguacgcccaggccagcggcagaaucaccgugagcaccaagagaagccagcagaccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154877 - RNA, 1698 nt, Artificial Sequence
  derived and/or modified sequence opt4 from hemagglutinin__InfluenzaA__ACF54598
augaaggccaagcugcuggugcugcuguacgccuucguggccaccgacgccgacaccaucugcaucggcuaccacgccaacaacagcaccgacaccguggacaccaucuucgagaagaacguggccgugacccacagcgugaaccugcuggaggacagacacaacggcaagcugugcaagcugaagggcaucgccccccugcagcugggcaagugcaacaucaucggcuggcugcugggcaaccccgagugcgacagccugcugcccgccagaagcuggagcuacaucguggagacccccaacagcgagaacggcgccugcuaccccggcgacuucaucgacuacgaggagcugagagagcagcugagcagcgugagcagccuggagagauucgagaucuuccccaaggagagcagcuggcccaaccacaccuucaacggcgugaccgccagcugcagccacagaggcaagagcagcuucuacagaaaccugcuguggcugaccaagaagggcgacagcuaccccaagcugaccaacagcuacgugaacaacaagggcaaggaggugcuggugcuguggggcgugcaccaccccagcagcagcgacgagcagcagagccuguacagcaacggcaacgccuacgugagcguggccagcagcaacuacaacagaagauucacccccgagaucgccgccagacccaaggugaaggaccagcacggcagaaugaacuacuacuggacccugcuggagcccggcgacaccaucaucuucgaggccaccggcaaccugaucgcccccugguacgccuucgcccugagcagaggcuucgagagcggcaucaucaccagcaacgccagcaugcacgagugcaacaccaagugccagaccccccagggcagcaucaacagcaaccugcccuuccagaacauccaccccgugaccaucggcgagugccccaaguacgugagaagcaccaagcugagaauggugaccggccugagaaacauccccagcauccaguacagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaaccuggagaagagaauggagaaccugaacaagaagguggacgacggcuuccuggacaucuggaccuacaacgccgagcugcuggugcugcuggagaacggcagaacccuggacuuccacgaccugaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154878 - RNA, 1704 nt, Artificial Sequence
  derived and/or modified sequence opt4 from hemagglutinin__InfluenzaA__ACG50699
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaugguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagccugggcgugagcagcgccugccccuaccagggcagcagcagcuucuucagaaacgugguguggcugaucaagaagaacaacgccuaccccaccaucaagagaagcuacaacaacaccaaccaggaggaccugcuggugcuguggggcauccaccaccccaacgacgaggccgagcagaccagacuguaccagaaccccaccaccuacaucagcgugggcaccagcacccugaaccagagacugauccccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcgagguggaguacggcaacugcaacaccaagugccagacccccaugggcgccaucaacagcagcaugcccuuccacaacauccacccccugaccaucggcgagugccccaaguacgugaagagcaacaagcuggugcuggccaccggccugagaaacagcccccagagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 154879 - RNA, 1701 nt, Artificial Sequence; identical to SEQ ID NO: 154448
  derived and/or modified sequence opt4 from hemagglutinin__InfluenzaA__ACG70142

SEQ ID NO: 154880 - RNA, 1701 nt, Artificial Sequence; identical to SEQ ID NO: 154448
  derived and/or modified sequence opt4 from hemagglutinin__InfluenzaA__ACG70153

SEQ ID NO: 154881 - RNA, 1701 nt, Artificial Sequence
  derived and/or modified sequence opt4 from hemagglutinin__InfluenzaA__ACG80410
augaagaccaucaucgcccugagcuacauccugugccugguguucgcccagaagcugcccggcaacgacaacagcaccgccacccugugccugggccaccacgccgugcccaacggcaccaucgugagaaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugagauucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154882 - RNA, 1701 nt, Artificial Sequence
  derived and/or modified sequence opt4 from hemagglutinin__InfluenzaA__ACG80420
augcagaccaucaucgcccugagcuacauccugugccugguguucgcccagaagcugcccggcaacgacaacagcaccgccacccugugccugggccaccacgccgugcccaacggcaccaucgugagaaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugagauucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154883 - RNA, 1701 nt, Artificial Sequence; identical to SEQ ID NO: 154881
  derived and/or modified sequence opt4 from hemagglutinin__InfluenzaA__ACG80426

SEQ ID NO: 154884 - RNA, 1701 nt, Artificial Sequence; identical to SEQ ID NO: 154881
  derived and/or modified sequence opt4 from hemagglutinin__InfluenzaA__ACG80430

SEQ ID NO: 154885 - RNA, 1701 nt, Artificial Sequence
  derived and/or modified sequence opt4 from hemagglutinin__InfluenzaA__ACG80436
augaagaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugagauucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgcccuggaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154886 - RNA, 1701 nt, Artificial Sequence
  derived and/or modified sequence opt4 from hemagglutinin__InfluenzaA__ACG80445
augaagaccaucaucgcccugagcuacauccugugccugguguucgcccagaagcugcccggcaacgacaacagcaccgccacccugugccugggccaccacgccgugcccaacggcaccaucgugagaaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugagauucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaaccagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154887 - RNA, 1701 nt, Artificial Sequence; identical to SEQ ID NO: 154881
  derived and/or modified sequence opt4 from hemagglutinin__InfluenzaA__ACG80454

SEQ ID NO: 154888 - RNA, 1701 nt, Artificial Sequence; identical to SEQ ID NO: 154881
  derived and/or modified sequence opt4 from hemagglutinin__InfluenzaA__ACG80463

SEQ ID NO: 154889 - RNA, 1701 nt, Artificial Sequence
  derived and/or modified sequence opt4 from hemagglutinin__InfluenzaA__ACG80472
augaagaccaucaucgcccugagcuacauccugugccugguguucgcccagaagcugcccggcaacgacaacagcaccgccacccugugccugggccaccacgccgugcccaacggcaccaucgugagaaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugagauucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgcccuggaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154890 - RNA, 1701 nt, Artificial Sequence
  derived and/or modified sequence opt4 from hemagglutinin__InfluenzaA__ACH69558
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugagauucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154891 - RNA, 1701 nt, Artificial Sequence
  derived and/or modified sequence opt4 from hemagglutinin__InfluenzaA__ACH69569
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacagccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154892 - RNA, 1701 nt, Artificial Sequence
  derived and/or modified sequence opt4 from hemagglutinin__InfluenzaA__ACH69580
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacgacuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154893 - RNA, 1701 nt, Artificial Sequence
  derived and/or modified sequence opt4 from hemagglutinin__InfluenzaA__ACH69591
augaagaccaucaucgcccugagcuacauccugugccuggccuucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaacagcuucuucagcagacugaacuggcugcaccagcugaaguacagauaccccgcccugaacgugaccaugcccaacaacgacaaguucgacaagcuguacaucuggggcgugcaccaccccagcaccgacagcgaccagaucagcguguacgcccaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacaagcugaucgagaagaccaacgagaaguuccaccagaucgagaacgaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154894 - RNA, 1701 nt, Artificial Sequence
  derived and/or modified sequence opt4 from hemagglutinin__InfluenzaA__ACH69602
augaagaccaucaucgcccugagcuacauccugugccuggccuucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaacagcuucuucagcagacugaacuggcugcaccagcugaaguacagauaccccgcccugaacgugaccaugcccaacaacgacaaguucgacaagcuguacaucuggggcgugcaccaccccagcaccgacagcgaccagaucagcguguacgcccaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacaagcugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154895 - RNA, 1701 nt, Artificial Sequence
  derived and/or modified sequence opt4 from hemagglutinin__InfluenzaA__ACH69613
augaagaccaucaucgcccugagcuacauccugugccuggccuucgcccagaagcugcccggcaacgacaacagcacccccacccugugccugggccaccacgccgugcccaacggcacccuggugaagaccaucaccaacgaccagaucgaggugaccaacgccaccgagcuggugcagagcagcagcaccggcggcaucugcgacagcccccaccagaucaucgacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaacagcuucuucagcagacugaacuggcugcaccagcugaaguacagauaccccgcccugaacgugaccaugcccaacaacgacaaguucgacaagcuguacaucuggggcgugcaccaccccagcaccgacagcgaccagaucagcguguacgcccaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccccaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggccugagacaccagaacagcgagggcaccggccaggccgccgaccugaagagcacccaggccgccaucaaccagaucaacggcaagcugaacaagcugaucgagaagaccaacgagaaguuccaccagaucgagaacgaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154896 - RNA, 1701 nt, Artificial Sequence; identical to SEQ ID NO: 153150
  derived and/or modified sequence opt4 from hemagglutinin__InfluenzaA__ACH82060

SEQ ID NO: 154897 - RNA, 1701 nt, Artificial Sequence; identical to SEQ ID NO: 154836
  derived and/or modified sequence opt4 from hemagglutinin__InfluenzaA__ACI06123

SEQ ID NO: 154898 - RNA, 1701 nt, Artificial Sequence; identical to SEQ ID NO: 154836
  derived and/or modified sequence opt4 from hemagglutinin__InfluenzaA__ACI06126

SEQ ID NO: 154899 - RNA, 1701 nt, Artificial Sequence; identical to SEQ ID NO: 154836
  derived and/or modified sequence opt4 from hemagglutinin__InfluenzaA__ACI06127

SEQ ID NO: 154900 - RNA, 1701 nt, Artificial Sequence; identical to SEQ ID NO: 154836
  derived and/or modified sequence opt4 from hemagglutinin__InfluenzaA__ACI06129

SEQ ID NO: 154901 - RNA, 1701 nt, Artificial Sequence; identical to SEQ ID NO: 154836
  derived and/or modified sequence opt4 from hemagglutinin__InfluenzaA__ACI06130

SEQ ID NO: 154902 - RNA, 1701 nt, Artificial Sequence; identical to SEQ ID NO: 154836
  derived and/or modified sequence opt4 from hemagglutinin__InfluenzaA__ACI06132

SEQ ID NO: 154903 - RNA, 1701 nt, Artificial Sequence; identical to SEQ ID NO: 154838
  derived and/or modified sequence opt4 from hemagglutinin__InfluenzaA__ACI06133

SEQ ID NO: 154904 - RNA, 1701 nt, Artificial Sequence; identical to SEQ ID NO: 154838
  derived and/or modified sequence opt4 from hemagglutinin__InfluenzaA__ACI06134

SEQ ID NO: 154905 - RNA, 1701 nt, Artificial Sequence; identical to SEQ ID NO: 154838
  derived and/or modified sequence opt4 from hemagglutinin__InfluenzaA__ACI06135

SEQ ID NO: 154906 - RNA, 1701 nt, Artificial Sequence; identical to SEQ ID NO: 154838
  derived and/or modified sequence opt4 from hemagglutinin__InfluenzaA__ACI06136

SEQ ID NO: 154907 - RNA, 1701 nt, Artificial Sequence; identical to SEQ ID NO: 154838
  derived and/or modified sequence opt4 from hemagglutinin__InfluenzaA__ACI06137

SEQ ID NO: 154908 - RNA, 1701 nt, Artificial Sequence; identical to SEQ ID NO: 154838
  derived and/or modified sequence opt4 from hemagglutinin__InfluenzaA__ACI06138

SEQ ID NO: 154909 - RNA, 1701 nt, Artificial Sequence; identical to SEQ ID NO: 154838
  derived and/or modified sequence opt4 from hemagglutinin__InfluenzaA__ACI06139

SEQ ID NO: 154910 - RNA, 1701 nt, Artificial Sequence; identical to SEQ ID NO: 154838
  derived and/or modified sequence opt4 from hemagglutinin__InfluenzaA__ACI06140

SEQ ID NO: 154911 - RNA, 1701 nt, Artificial Sequence; identical to SEQ ID NO: 154838
  derived and/or modified sequence opt4 from hemagglutinin__InfluenzaA__ACI06141

SEQ ID NO: 154912 - RNA, 1701 nt, Artificial Sequence; identical to SEQ ID NO: 154838
  derived and/or modified sequence opt4 from hemagglutinin__InfluenzaA__ACI06142

SEQ ID NO: 154913 - RNA, 1701 nt, Artificial Sequence; identical to SEQ ID NO: 154838
  derived and/or modified sequence opt4 from hemagglutinin__InfluenzaA__ACI06143

SEQ ID NO: 154914 - RNA, 1701 nt, Artificial Sequence
  derived and/or modified sequence opt4 from hemagglutinin__InfluenzaA__ACI06144
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacagacuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154915 - RNA, 1701 nt, Artificial Sequence; identical to SEQ ID NO: 154838
  derived and/or modified sequence opt4 from hemagglutinin__InfluenzaA__ACI06145

SEQ ID NO: 154916 - RNA, 1701 nt, Artificial Sequence
  derived and/or modified sequence opt4 from hemagglutinin__InfluenzaA__ACI06146
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagccccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacuacgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154917 - RNA, 1701 nt, Artificial Sequence; identical to SEQ ID NO: 154838
  derived and/or modified sequence opt4 from hemagglutinin__InfluenzaA__ACI06147

SEQ ID NO: 154918 - RNA, 1701 nt, Artificial Sequence; identical to SEQ ID NO: 154838
  derived and/or modified sequence opt4 from hemagglutinin__InfluenzaA__ACI06148

SEQ ID NO: 154919 - RNA, 1701 nt, Artificial Sequence
  derived and/or modified sequence opt4 from hemagglutinin__InfluenzaA__ACI06149
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagcagacagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154920 - RNA, 1701 nt, Artificial Sequence; identical to SEQ ID NO: 154849
  derived and/or modified sequence opt4 from hemagglutinin__InfluenzaA__ACI06151

SEQ ID NO: 154921 - RNA, 1701 nt, Artificial Sequence; identical to SEQ ID NO: 154849
  derived and/or modified sequence opt4 from hemagglutinin__InfluenzaA__ACI06152

SEQ ID NO: 154922 - RNA, 1701 nt, Artificial Sequence
  derived and/or modified sequence opt4 from hemagglutinin__InfluenzaA__ACI06153
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgagcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154923 - RNA, 1701 nt, Artificial Sequence
  derived and/or modified sequence opt4 from hemagglutinin__InfluenzaA__ACI06155
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucgagagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucgugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154924 - RNA, 1701 nt, Artificial Sequence; identical to SEQ ID NO: 154849
  derived and/or modified sequence opt4 from hemagglutinin__InfluenzaA__ACI06156

SEQ ID NO: 154925 - RNA, 1701 nt, Artificial Sequence; identical to SEQ ID NO: 154849
  derived and/or modified sequence opt4 from hemagglutinin__InfluenzaA__ACI06157

SEQ ID NO: 154926 - RNA, 1701 nt, Artificial Sequence; identical to SEQ ID NO: 154849
  derived and/or modified sequence opt4 from hemagglutinin__InfluenzaA__ACI06158

SEQ ID NO: 154927 - RNA, 1701 nt, Artificial Sequence; identical to SEQ ID NO: 154849
  derived and/or modified sequence opt4 from hemagglutinin__InfluenzaA__ACI06159

SEQ ID NO: 154928 - RNA, 1701 nt, Artificial Sequence; identical to SEQ ID NO: 154838
  derived and/or modified sequence opt4 from hemagglutinin__InfluenzaA__ACI06160

SEQ ID NO: 154929 - RNA, 1701 nt, Artificial Sequence
  derived and/or modified sequence opt4 from hemagglutinin__InfluenzaA__ACI06161
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucgagagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaagggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154930 - RNA, 1701 nt, Artificial Sequence
  derived and/or modified sequence opt4 from hemagglutinin__InfluenzaA__ACI06162
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucgagagcagacccugggugagaggccugagcagcagaaucagcaucuacuggaccaucgugaaccccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154931 - RNA, 1701 nt, Artificial Sequence
  derived and/or modified sequence opt4 from hemagglutinin__InfluenzaA__ACI06163
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaagggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154932 - RNA, 1701 nt, Artificial Sequence
  derived and/or modified sequence opt4 from hemagglutinin__InfluenzaA__ACI06164
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucaacaucuacuggaccaucgugaagcccggcgacgugcuggugaucaacagcaacggcaaccugaucgcccccagaggcuacuucaagaugagaaacggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154933 - RNA, 1701 nt, Artificial Sequence
  derived and/or modified sequence opt4 from hemagglutinin__InfluenzaA__ACI06165
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaacggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154934 - RNA, 1701 nt, Artificial Sequence
  derived and/or modified sequence opt4 from hemagglutinin__InfluenzaA__ACI06166
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccuggaucagaggccugagcagcagaaucaacaucuacuggaccaucgugaagcccggcgacgugcuggugaucaacagcaacggcaaccugaucgcccccagaggcuacuucaagaugagaaacggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154935 - RNA, 1701 nt, Artificial Sequence; identical to SEQ ID NO: 154919
  derived and/or modified sequence opt4 from hemagglutinin__InfluenzaA__ACI06167

SEQ ID NO: 154936 - RNA, 1701 nt, Artificial Sequence
  derived and/or modified sequence opt4 from hemagglutinin__InfluenzaA__ACI06168
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154937 - RNA, 1701 nt, Artificial Sequence; identical to SEQ ID NO: 154838
  derived and/or modified sequence opt4 from hemagglutinin__InfluenzaA__ACI06169

SEQ ID NO: 154938 - RNA, 1701 nt, Artificial Sequence; identical to SEQ ID NO: 154855
  derived and/or modified sequence opt4 from hemagglutinin__InfluenzaA__ACI06171

SEQ ID NO: 154939 - RNA, 1701 nt, Artificial Sequence; identical to SEQ ID NO: 154855
  derived and/or modified sequence opt4 from hemagglutinin__InfluenzaA__ACI06172

SEQ ID NO: 154940 - RNA, 1701 nt, Artificial Sequence
  derived and/or modified sequence opt4 from hemagglutinin__InfluenzaA__ACI06173
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggagaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154941 - RNA, 1701 nt, Artificial Sequence; identical to SEQ ID NO: 154855
  derived and/or modified sequence opt4 from hemagglutinin__InfluenzaA__ACI06174

SEQ ID NO: 154942 - RNA, 1701 nt, Artificial Sequence; identical to SEQ ID NO: 154856
  derived and/or modified sequence opt4 from hemagglutinin__InfluenzaA__ACI06175

SEQ ID NO: 154943 - RNA, 1701 nt, Artificial Sequence; identical to SEQ ID NO: 154856
  derived and/or modified sequence opt4 from hemagglutinin__InfluenzaA__ACI06176

SEQ ID NO: 154944 - RNA, 1701 nt, Artificial Sequence; identical to SEQ ID NO: 154856
  derived and/or modified sequence opt4 from hemagglutinin__InfluenzaA__ACI06177

SEQ ID NO: 154945 - RNA, 1689 nt, Artificial Sequence
  derived and/or modified sequence opt4 from hemagglutinin__InfluenzaA__ACI25724
auggccaucaucuaccugauccugcuguucgccaccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagagagagaaccccagauacagccugugcuaccccggcagccugaacgacuacgaggagcugaagcaccugcugagcagcgugaagcacuucgagaaggugagaauccugcccaaggacagauggacccagcacaccaccaccggcggcagcaaggccugcgccgugagcggcaagcccagcuucuucagaaacaugguguggcugaccaagaagggccccaacuaccccguggccaagggcagcuacaacaacaccagcggcgagcagaugcugaucaucuggggcgugcaccaccccaaggacgaggccgagcagagagcccuguaccaggaggugggcaccuacgugagcgccagcaccagcacccugaacaagagaagcauccccgagaucgccgccagacccgaggugaacggccugggcagcagaauggaguucagcuggacccugcuggacgugugggacaccaucaacuucgagagcaccggcaaccugguggcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucaacaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgagaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaagagaaacgagaucaagggcgugaagcugagcagcaugggcguguaccagauccuggccaucuacgccaccguggccggcagccugagccuggccaucaugguggccggcaucagcuucuggaugugcagcaacggcagccugcagugcagaaucugcaucuga

SEQ ID NO: 154946 - RNA, 1701 nt, Artificial Sequence
  derived and/or modified sequence opt4 from hemagglutinin__InfluenzaA__ACI25746
augaagaccaucaucgcccugagcuacaucuucugccuggcccugggccaguaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucgacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154947 - RNA, 1701 nt, Artificial Sequence
  derived and/or modified sequence opt4 from hemagglutinin__InfluenzaA__ACI25757
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccuggugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154948 - RNA, 1701 nt, Artificial Sequence; identical to SEQ ID NO: 154836
  derived and/or modified sequence opt4 from hemagglutinin__InfluenzaA__ACI25768

SEQ ID NO: 154949 - RNA, 1701 nt, Artificial Sequence
  derived and/or modified sequence opt4 from hemagglutinin__InfluenzaA__ACI25779
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucuggagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154950 - RNA, 1701 nt, Artificial Sequence
  derived and/or modified sequence opt4 from hemagglutinin__InfluenzaA__ACI25790
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucuggagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaagcggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154951 - RNA, 1701 nt, Artificial Sequence
  derived and/or modified sequence opt4 from hemagglutinin__InfluenzaA__ACI25801
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucaacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgaggacuucaccuggaccggcgugacccagaacggcggcagcaacgccugcaagagaggccccggcagcggcuucuucagcagacugaacuggcugaccaagagcggcagcaccuaccccgugcuggacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154952 - RNA, 1689 nt, Artificial Sequence; identical to SEQ ID NO: 154870
  derived and/or modified sequence opt4 from hemagglutinin__InfluenzaA__ACI26274

SEQ ID NO: 154953 - RNA, 1698 nt, Artificial Sequence
  derived and/or modified sequence opt4 from hemagglutinin__InfluenzaA__ACI26307
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccgugaccgacaacgaccagaucuuccuguacgcccagagcggcagaaucaccgugagcaccaagagaagccagcagaccgugauccccaacaucggcagcagacccagagugagaaacagccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154954 - RNA, 1701 nt, Artificial Sequence
  derived and/or modified sequence opt4 from hemagglutinin__InfluenzaA__ACI26362
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154955 - RNA, 1701 nt, Artificial Sequence
  derived and/or modified sequence opt4 from hemagglutinin__InfluenzaA__ACI26373
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaaagagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154956 - RNA, 1701 nt, Artificial Sequence; identical to SEQ ID NO: 154821
  derived and/or modified sequence opt4 from hemagglutinin__InfluenzaA__ACI26395

SEQ ID NO: 154957 - RNA, 1701 nt, Artificial Sequence
  derived and/or modified sequence opt4 from hemagglutinin__InfluenzaA__ACI26406
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaagcaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154958 - RNA, 1701 nt, Artificial Sequence; identical to SEQ ID NO: 154448
  derived and/or modified sequence opt4 from hemagglutinin__InfluenzaA__ACI26417

SEQ ID NO: 154959 - RNA, 1701 nt, Artificial Sequence
  derived and/or modified sequence opt4 from hemagglutinin__InfluenzaA__ACI26428
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcagcugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccgugaccgacaacgaccagaucagacuguacgcccaggccagcggcagaaucaccgugagcaccaagagaagccagcagaccgugauccccaacaucggcuacagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154960 - RNA, 1698 nt, Artificial Sequence
  derived and/or modified sequence opt4 from hemagglutinin__InfluenzaA__ACI26439
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcaaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154961 - RNA, 1698 nt, Artificial Sequence; identical to SEQ ID NO: 154960
  derived and/or modified sequence opt4 from hemagglutinin__InfluenzaA__ACI26450

SEQ ID NO: 154962 - RNA, 1701 nt, Artificial Sequence
  derived and/or modified sequence opt4 from hemagglutinin__InfluenzaA__ACI26461
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccccuacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154963 - RNA, 1698 nt, Artificial Sequence
  derived and/or modified sequence opt4 from hemagglutinin__InfluenzaA__ACI26472
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccgugaccgacaacgaccagaucuuccuguacgcccagagcggcagaaucaccgugagcaccaagagaagccagcagaccgugauccccaacaucggcuacagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154964 - RNA, 1701 nt, Artificial Sequence; identical to SEQ ID NO: 154955
  derived and/or modified sequence opt4 from hemagglutinin__InfluenzaA__ACI26483

SEQ ID NO: 154965 - RNA, 1701 nt, Artificial Sequence
  derived and/or modified sequence opt4 from hemagglutinin__InfluenzaA__ACI26505
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaaagagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucagaagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154966 - RNA, 1701 nt, Artificial Sequence; identical to SEQ ID NO: 154954
  derived and/or modified sequence opt4 from hemagglutinin__InfluenzaA__ACI26516

SEQ ID NO: 154967 - RNA, 1701 nt, Artificial Sequence; identical to SEQ ID NO: 154955
  derived and/or modified sequence opt4 from hemagglutinin__InfluenzaA__ACI26527

SEQ ID NO: 154968 - RNA, 1701 nt, Artificial Sequence
  derived and/or modified sequence opt4 from hemagglutinin__InfluenzaA__ACI26538
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgacaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154969 - RNA, 1701 nt, Artificial Sequence
  derived and/or modified sequence opt4 from hemagglutinin__InfluenzaA__ACI26549
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuacagcaacugcuaccccuacgacgugcccgacuacgccagccugagaagccugguggccagcagcggcacccuggaguucaucaacgaggacuucaacuggaccggcgugacccagagcggcggcagcuacagcugcaagagaggcagcgugaacagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaagcuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggaggaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154970 - RNA, 1701 nt, Artificial Sequence
  derived and/or modified sequence opt4 from hemagglutinin__InfluenzaA__ACI26560
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcggcagcuacgccugcaagagaggcagcgugaacagcuucuucagcagacugaacuggcugcacgagagcgaguacaaguaccccgcccugaacgugaccaugcccaacaacggcaaguucgacaagcuguacaucuggggcgugcaccaccccaucaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154971 - RNA, 1701 nt, Artificial Sequence
  derived and/or modified sequence opt4 from hemagglutinin__InfluenzaA__ACI26571
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcggcagcuacgccugcaagagaggcagcgugaacagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaagcuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154972 - RNA, 1701 nt, Artificial Sequence
  derived and/or modified sequence opt4 from hemagglutinin__InfluenzaA__ACI26593
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgaggacuucaacuggaccggcguggcccagagcggcgagagcuacgccugcaagagaggcagcgugaagagcuucuucagcagacugaacuggcugcacaagagcgacuacaaguaccccgcccugaacgugaccaugcccaacaacggcaaguucgacaagcuguacaucuggggcgugcaccaccccagcaccgacagagagcagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154973 - RNA, 1698 nt, Artificial Sequence
  derived and/or modified sequence opt4 from hemagglutinin__InfluenzaA__ACI32715
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacaccgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154974 - RNA, 1698 nt, Artificial Sequence
  derived and/or modified sequence opt4 from hemagglutinin__InfluenzaA__ACI32716
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcaccaucugcaucuga

SEQ ID NO: 154975 - RNA, 1698 nt, Artificial Sequence
  derived and/or modified sequence opt4 from hemagglutinin__InfluenzaA__ACI32717
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaugaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucaacuucuggaugugcagcaacggcagccugcagugcaagaucugcaucuga

SEQ ID NO: 154976 - RNA, 1698 nt, Artificial Sequence
  derived and/or modified sequence opt4 from hemagglutinin__InfluenzaA__ACI32718
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgccaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggaggugggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcaccaucugcaucuga

SEQ ID NO: 154977 - RNA, 1698 nt, Artificial Sequence; identical to SEQ ID NO: 154974
  derived and/or modified sequence opt4 from hemagglutinin__InfluenzaA__ACI32719

SEQ ID NO: 154978 - RNA, 1698 nt, Artificial Sequence; identical to SEQ ID NO: 154974
  derived and/or modified sequence opt4 from hemagglutinin__InfluenzaA__ACI32720

SEQ ID NO: 154979 - RNA, 1698 nt, Artificial Sequence
  derived and/or modified sequence opt4 from hemagglutinin__InfluenzaA__ACI32721
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucagcuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154980 - RNA, 1698 nt, Artificial Sequence; identical to SEQ ID NO: 154974
  derived and/or modified sequence opt4 from hemagglutinin__InfluenzaA__ACI32722

SEQ ID NO: 154981 - RNA, 1698 nt, Artificial Sequence
  derived and/or modified sequence opt4 from hemagglutinin__InfluenzaA__ACI32723
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcuucuga

SEQ ID NO: 154982 - RNA, 1698 nt, Artificial Sequence
  derived and/or modified sequence opt4 from hemagglutinin__InfluenzaA__ACI32724
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcugaagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcaagaucugcaucuga

SEQ ID NO: 154983 - RNA, 1698 nt, Artificial Sequence; identical to SEQ ID NO: 153905
  derived and/or modified sequence opt4 from hemagglutinin__InfluenzaA__ACI32725

SEQ ID NO: 154984 - RNA, 1698 nt, Artificial Sequence
  derived and/or modified sequence opt4 from hemagglutinin__InfluenzaA__ACI32726
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcaucuaccagauccuggccaucuacagcaccgugaccagcagccuggugcugcuggugagccugggcgccaucagcuucuggaugugcagcaacggcagccugcagugcagaaucugcaucuga

SEQ ID NO: 154985 - RNA, 1698 nt, Artificial Sequence
  derived and/or modified sequence opt4 from hemagglutinin__InfluenzaA__ACI32727
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcaucagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugacccugggcgccaucagcuucuggaugugcagcaacggcagccugcagugcaccaucugcaucuga

SEQ ID NO: 154986 - RNA, 1698 nt, Artificial Sequence
  derived and/or modified sequence opt4 from hemagglutinin__InfluenzaA__ACI32729
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugauccccaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcgugaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154987 - RNA, 1698 nt, Artificial Sequence; identical to SEQ ID NO: 154986
  derived and/or modified sequence opt4 from hemagglutinin__InfluenzaA__ACI32730

SEQ ID NO: 154988 - RNA, 1698 nt, Artificial Sequence
  derived and/or modified sequence opt4 from hemagglutinin__InfluenzaA__ACI32731
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucaaccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcaagaucugcaucuga

SEQ ID NO: 154989 - RNA, 1698 nt, Artificial Sequence
  derived and/or modified sequence opt4 from hemagglutinin__InfluenzaA__ACI32732
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcaccaucugcaucuga

SEQ ID NO: 154990 - RNA, 1698 nt, Artificial Sequence
  derived and/or modified sequence opt4 from hemagglutinin__InfluenzaA__ACI32733
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucaacagcgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcaccaucugcaucuga

SEQ ID NO: 154991 - RNA, 1698 nt, Artificial Sequence
  derived and/or modified sequence opt4 from hemagglutinin__InfluenzaA__ACI32734
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaagaagaaggaggugcuggugcuguggggcgugcaccacccccccaacaucggcgaccagaaggcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcaccaucugcaucuga

SEQ ID NO: 154992 - RNA, 1698 nt, Artificial Sequence
  derived and/or modified sequence opt4 from hemagglutinin__InfluenzaA__ACI32736
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgccaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugagaaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154993 - RNA, 1698 nt, Artificial Sequence
  derived and/or modified sequence opt4 from hemagglutinin__InfluenzaA__ACI32737
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugauccccaaggagagcuggagcuacaucguggagauccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggccugggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugagaaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154994 - RNA, 1698 nt, Artificial Sequence
  derived and/or modified sequence opt4 from hemagglutinin__InfluenzaA__ACI32739
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcaaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcaagaucugcaucuga

SEQ ID NO: 154995 - RNA, 1698 nt, Artificial Sequence
  derived and/or modified sequence opt4 from hemagglutinin__InfluenzaA__ACI32740
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggcuacuucgccgacuacgaggagcugagagagcagcugagcagcgugagcagcuucgagagauucgagaucuuccccaaggagagcagcuggcccaagcacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugccccaacggcagccugcagugcaccaucugcaucuga

SEQ ID NO: 154996 - RNA, 1698 nt, Artificial Sequence
  derived and/or modified sequence opt4 from hemagglutinin__InfluenzaA__ACI32741
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggcuacuucgccgacuacgaggagcugagagagcagcugagcagcgugagcagcuucgagagauucgagaucuuccccaaggagagcagcuggcccaagcacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugccccaacggcagccugcagugcaagaucugcaucuga

SEQ ID NO: 154997 - RNA, 1698 nt, Artificial Sequence
  derived and/or modified sequence opt4 from hemagglutinin__InfluenzaA__ACI32742
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcaagaucugcaucuga

SEQ ID NO: 154998 - RNA, 1698 nt, Artificial Sequence
  derived and/or modified sequence opt4 from hemagglutinin__InfluenzaA__ACI32743
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggcuacuucgccgacuacgaggagcugagagagcagcugagcagcgugagcagcuucgagagauucgagaucuuccccaagaagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcaaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154999 - RNA, 1701 nt, Artificial Sequence
  derived and/or modified sequence opt4 from hemagglutinin__InfluenzaA__ACJ09818
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagguggaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccugcugugcguggcccugcugggcuucaucaugugggccugccagaagggcaacaucagaugcaacaucugcaucuga

SEQ ID NO: 155000 - RNA, 1683 nt, Artificial Sequence
  derived and/or modified sequence opt4 from hemagglutinin__InfluenzaA__ACJ67533
auggagaccaucagccugaucaccauccugcugguggugaccgccagcaacgccgacaagaucugcaucggccaccagagcaccaacagcaccgagaccguggacacccugaccgagaccaacgugcccgugacccacgccaaggagcugcugcacaccgagcacaacggcaugcugugcgccaccagccugggccacccccugauccuggacaccugcaccaucgagggccugguguacggcaaccccagcugcgaccugcugcuggagggcagagaguggagcuacaucguggagagaagcagcgccgugaacggcaccugcuaccccggcaacguggagaaccuggaggagcugagaacccuguucagcagcgccagcagcuaccagagaauccagaucuuccccgacaccaccuggaacgugaccuacaccggcaccagcagagccugcagcggcagcuucuacagaagcaugagauggcugacccagaagagcggcuucuaccccgugcaggacgcccaguacaccaacaacagaggcaagagcauccuguucguguggggcauccaccacccccccaccuacgccgagcagaccaaccuguacaucagaaacgacaccaccaccagcgugaccaccgaggaccugaacagaaccuucaagcccgugaucggccccagaccccuggugaacggccugcagggcagaaucgacuacuacuggagcgugcugaagcccggccagacccugagagugagaagcaacggcaaccugaucgcccccugguacggccacgugcugagcggcggcagccacggcagaauccugaagaccgaccugaagagcggcagcugcguggugcagugccagaccgagaagggcggccugaacagcacccugcccuuccacaacaucagcaaguacgccuucggcaccugccccaaguacgugagagugaacagccugaagcuggccgugggccugagaaacgugcccgccagaagcagcagaggccuguucggcgccaucgccggcuucaucgagggcggcuggcccggccugguggccggcugguacggcuuccagcacagcaacgaccagggcgugggcauggccgccgacagagacagcacccagaaggccaucgacaagaucaccagcaaggugaacaacaucguggacaagaugaacaagcaguacgagaucaucgaccacgaguucagcgagguggagaccagacugaacaugaucaacaacaagaucgacgaccagauccaggacgugugggccuacaacgccgagcugcuggugcugcuggagaaccagaagacccuggacgagcacgacgccaacgugaacaaccuguacaacaaggugaagagagcccugggcagcaacgccauggaggacggcaagggcugcuucgagcuguaccacaagugcgacgaccagugcauggagaccaucagaaacggcaccuacaacagaagaaaguacagagaggagagcagacuggagagacagaagaucgagggcgugaagcuggagagcgagagaaccuacaagauccugaccaucuacagcaccguggccagcagccuggugcuggccaugggcuucgccgccuuccuguucugggccaugagcaacggcagcugcagaugcaacaucugcaucuga

SEQ ID NO: 155001 - RNA, 1704 nt, Artificial Sequence
  derived and/or modified sequence opt4 from hemagglutinin__InfluenzaA__ACJ68607
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugggcgacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 155002 - RNA, 1704 nt, Artificial Sequence
  derived and/or modified sequence opt4 from hemagglutinin__InfluenzaA__ACJ68609
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugagaagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 155003 - RNA, 1704 nt, Artificial Sequence
  derived and/or modified sequence opt4 from hemagglutinin__InfluenzaA__ACJ68610
auggagaagaucgugcuguuccuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaucaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 155004 - RNA, 1704 nt, Artificial Sequence
  derived and/or modified sequence opt4 from hemagglutinin__InfluenzaA__ACJ68611
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagccugggcgugagcagcgccugccccuaccagggcaugcccagcuucuucagaaacgugguguggcugaucaagaagaacaacaccuaccccaccaucaagagaagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcgaggugggcuacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacgacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 155005 - RNA, 1704 nt, Artificial Sequence
  derived and/or modified sequence opt4 from hemagglutinin__InfluenzaA__ACJ68612
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggcccgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacaacgccgccgagcagaccaagcuguaccagaaccccaccaccuacaucagcgugggcaccagcacccugaaccugagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcgccuaccagauccugagcaucuacagcaccguggccagcagccuggcccuggccaucaugguggccggccugagccuguggaugugcagcaacggcagccugcagugcagaaucugcaucuga

SEQ ID NO: 155006 - RNA, 1704 nt, Artificial Sequence
  derived and/or modified sequence opt4 from hemagglutinin__InfluenzaA__ACJ68613
auggagaagaucgugcuguuccuggccaucgugagccacgugaagagcgaccagaucugcaucggcuaccacgccaacaacagcaccgagcagguggacaccaucauggagaagaacgugaccgugacccacgcccaggacauccuggagaagacccacaacggcaagcugugcgaccugggcggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgugugccccuaccagggcacccccagcuucuucagaaacgugguguggcugaucaagaagaacaacaccuaccccaccaucaagaagagcuacaacaacaccaaccaggaggaccugcugauccuguggggcauccaccacagcaacgacgccgccgagcagaccaagcuguaccagaaccccaccaccuacaucagcgugggcaccagcacccugaaccagagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 155007 - RNA, 1707 nt, Artificial Sequence
  derived and/or modified sequence opt4 from hemagglutinin__InfluenzaA__ACJ68614
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgugaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaagaacaacaccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagcuggccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagagaggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 155008 - RNA, 1698 nt, Artificial Sequence
  derived and/or modified sequence opt4 from hemagglutinin__InfluenzaA__ACK99007
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155009 - RNA, 1698 nt, Artificial Sequence
  derived and/or modified sequence opt4 from hemagglutinin__InfluenzaA__ACK99008
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcauggagguguaccagauccuggccaucuacagcaccguggccagcagccuggugcugcuggugagccugggcgccaucagcuucuggaugugcagcaacggcagccugcagugcagaaucugcaucuga

SEQ ID NO: 155010 - RNA, 1698 nt, Artificial Sequence
  derived and/or modified sequence opt4 from hemagglutinin__InfluenzaA__ACK99009
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaccuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155011 - RNA, 1698 nt, Artificial Sequence; identical to SEQ ID NO: 155008
  derived and/or modified sequence opt4 from hemagglutinin__InfluenzaA__ACK99011

SEQ ID NO: 155012 - RNA, 1698 nt, Artificial Sequence
  derived and/or modified sequence opt4 from hemagglutinin__InfluenzaA__ACK99012
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcugaucagccugggcgccaucagcuucuggaugugcagcaacggcagccugcagugcagaaucugcaucuga

SEQ ID NO: 155013 - RNA, 1698 nt, Artificial Sequence; identical to SEQ ID NO: 155008
  derived and/or modified sequence opt4 from hemagglutinin__InfluenzaA__ACK99013

SEQ ID NO: 155014 - RNA, 1698 nt, Artificial Sequence
  derived and/or modified sequence opt4 from hemagglutinin__InfluenzaA__ACK99014
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucacccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155015 - RNA, 1698 nt, Artificial Sequence; identical to SEQ ID NO: 155008
  derived and/or modified sequence opt4 from hemagglutinin__InfluenzaA__ACK99016

SEQ ID NO: 155016 - RNA, 1698 nt, Artificial Sequence; identical to SEQ ID NO: 155008
  derived and/or modified sequence opt4 from hemagglutinin__InfluenzaA__ACK99018

SEQ ID NO: 155017 - RNA, 1698 nt, Artificial Sequence; identical to SEQ ID NO: 155008
  derived and/or modified sequence opt4 from hemagglutinin__InfluenzaA__ACK99023

SEQ ID NO: 155018 - RNA, 1698 nt, Artificial Sequence
  derived and/or modified sequence opt4 from hemagglutinin__InfluenzaA__ACK99026
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccaucaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155019 - RNA, 1698 nt, Artificial Sequence; identical to SEQ ID NO: 154692
  derived and/or modified sequence opt4 from hemagglutinin__InfluenzaA__ACK99027

SEQ ID NO: 155020 - RNA, 1698 nt, Artificial Sequence
  derived and/or modified sequence opt4 from hemagglutinin__InfluenzaA__ACK99028
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccaagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155021 - RNA, 1698 nt, Artificial Sequence
  derived and/or modified sequence opt4 from hemagglutinin__InfluenzaA__ACK99029
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucagcaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155022 - RNA, 1698 nt, Artificial Sequence; identical to SEQ ID NO: 155008
  derived and/or modified sequence opt4 from hemagglutinin__InfluenzaA__ACK99030

SEQ ID NO: 155023 - RNA, 1698 nt, Artificial Sequence; identical to SEQ ID NO: 155008
  derived and/or modified sequence opt4 from hemagglutinin__InfluenzaA__ACK99031

SEQ ID NO: 155024 - RNA, 1698 nt, Artificial Sequence; identical to SEQ ID NO: 155008
  derived and/or modified sequence opt4 from hemagglutinin__InfluenzaA__ACK99032

SEQ ID NO: 155025 - RNA, 1698 nt, Artificial Sequence; identical to SEQ ID NO: 155008
  derived and/or modified sequence opt4 from hemagglutinin__InfluenzaA__ACK99033

SEQ ID NO: 155026 - RNA, 1698 nt, Artificial Sequence
  derived and/or modified sequence opt4 from hemagglutinin__InfluenzaA__ACK99034
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagagacuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155027 - RNA, 1698 nt, Artificial Sequence
  derived and/or modified sequence opt4 from hemagglutinin__InfluenzaA__ACK99035
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcgccuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucagcaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacacccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155028 - RNA, 1701 nt, Artificial Sequence; identical to SEQ ID NO: 154858
  derived and/or modified sequence opt4 from hemagglutinin__InfluenzaA__ACK99421

SEQ ID NO: 155029 - RNA, 1689 nt, Artificial Sequence
  derived and/or modified sequence opt4 from hemagglutinin__InfluenzaA__ACK99432
auggccaucaucuaccugauccugcuguucaccgccgugagaggcgaccagaucugcaucggcuaccacgccaacaacagcaccgagaagaucgacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacagccugugcuaccccggcagcuucaacgacuacgaggagcugaagcaccugcugagcagcgugaagcacuucgagaaggugaagauccugcccaaggacagauggacccagcacaccaccaccggcggcagcauggccugcgccgugagcggcaagcccagcuucuucagaaacaugguguggcugaccaccaagggccccaacuaccccguggcccagggcagcuacaacaacaccagcggcgagcagaugcugaucaucuggggcgugcaccaccccaacgacgaggccgagcagagagcccuguaccagaaggugggcaccuacgugagcgccagcaccagcacccuguacaagagaagcauccccgagaucgccgccagacccaaggugaacggccugggcagcagaauggaguucagcuggacccugcuggacaugugggacaccaucaacuucgagagcaccggcaaccugguggcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacaacgagugcauggacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 155030 - RNA, 1701 nt, Artificial Sequence
  derived and/or modified sequence opt4 from hemagglutinin__InfluenzaA__ACK99443
augaaggccaagcugcuggugcugcugugcgccuucaccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcaucgccggcuggauccugggcaaccccgagugcgagagccuguucagcaaggagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccgccugcagccacaacggcaagagcagcuucuacagaaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcgugcagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155031 - RNA, 1701 nt, Artificial Sequence
  derived and/or modified sequence opt4 from hemagglutinin__InfluenzaA__ACK99465
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagaagcccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccaagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacaagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcaagcugaagagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155032 - RNA, 1701 nt, Artificial Sequence
  derived and/or modified sequence opt4 from hemagglutinin__InfluenzaA__ACK99476
augaagaccaucaucgcccugagcuacauccugugcaugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacgacuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcgugaagagcuucuucagcagacugaacuggcugcacaagcuggaguacaaguaccccgcccugaacgugaccaugcccaacaacgacaaguucgacaagcuguacaucuggggcgugcaccaccccagaaccgacagcgaccagaccagccuguacgugcaggccagcggcagagugaccgugagcaccaagagaagccagcagaccgugauccccaacaucggcagcagccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 155033 - RNA, 1698 nt, Artificial Sequence; identical to SEQ ID NO: 154434
  derived and/or modified sequence opt4 from hemagglutinin__InfluenzaA__ACL12063

SEQ ID NO: 155034 - RNA, 1701 nt, Artificial Sequence
  derived and/or modified sequence opt4 from hemagglutinin__InfluenzaA__ACL12129
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcggcagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugacccccaacaucggcagcagacccugggugagaggccagagcagcagaaucagcaucuacuggaccaucgugaagcccggcgacauccugcugaucgacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccagcagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 155035 - RNA, 1701 nt, Artificial Sequence; identical to SEQ ID NO: 154876
  derived and/or modified sequence opt4 from hemagglutinin__InfluenzaA__ACL12140

SEQ ID NO: 155036 - RNA, 1698 nt, Artificial Sequence; identical to SEQ ID NO: 154960
  derived and/or modified sequence opt4 from hemagglutinin__InfluenzaA__ACL12151

SEQ ID NO: 155037 - RNA, 1701 nt, Artificial Sequence; identical to SEQ ID NO: 154954
  derived and/or modified sequence opt4 from hemagglutinin__InfluenzaA__ACL12162

SEQ ID NO: 155038 - RNA, 1701 nt, Artificial Sequence
  derived and/or modified sequence opt4 from hemagglutinin__InfluenzaA__ACL12173
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155039 - RNA, 1701 nt, Artificial Sequence
  derived and/or modified sequence opt4 from hemagglutinin__InfluenzaA__ACL12184
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155040 - RNA, 1701 nt, Artificial Sequence; identical to SEQ ID NO: 154954
  derived and/or modified sequence opt4 from hemagglutinin__InfluenzaA__ACL12195

SEQ ID NO: 155041 - RNA, 1701 nt, Artificial Sequence
  derived and/or modified sequence opt4 from hemagglutinin__InfluenzaA__ACL12217
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacgugcugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155042 - RNA, 1701 nt, Artificial Sequence; identical to SEQ ID NO: 154954
  derived and/or modified sequence opt4 from hemagglutinin__InfluenzaA__ACL12228

SEQ ID NO: 155043 - RNA, 1701 nt, Artificial Sequence; identical to SEQ ID NO: 154954
  derived and/or modified sequence opt4 from hemagglutinin__InfluenzaA__ACL12239

SEQ ID NO: 155044 - RNA, 1701 nt, Artificial Sequence
  derived and/or modified sequence opt4 from hemagglutinin__InfluenzaA__ACL12250
augaagaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaacugggaccuguucguggagagaagcaaggccuacagcaacugcuaccccuacgacgugcccgacuacgugagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 155045 - RNA, 1701 nt, Artificial Sequence
  derived and/or modified sequence opt4 from hemagglutinin__InfluenzaA__ACL12261
augaaggccaagcugcuggugcugcugugcgccuucaccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccgccugcagccacaagggcagaagcagcuucuacagaaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacaacagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155046 - RNA, 1689 nt, Artificial Sequence
  derived and/or modified sequence opt4 from hemagglutinin__InfluenzaA__ACN32272
auggccaucaucuaccugauccugcuguucaccgccgugagaggcgaccagaucugcaucggcuaccacgccaacaacagcaccgagaagaucgacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccagauacagccugugcuaccccggcagcuucaacgacuacgaggagcugaagcaccugcugagcagcgugaagcacuucgagaaggugaagauccugcccaaggacagauggacccagcacaccaccaccggcggcagcauggccugcgccgugagcggcaagcccagcuucuucagaaacaugguguggcugaccaccaagggccccaacuaccccguggcccagggcagcuacaacaacaccagcggcgagcagaugcugaucaucuggggcgugcaccaccccaacgacgaggccgagcagagagcccuguaccagaacgugggcaccuacgugagcgccagcaccagcacccuguacaagagaagcauccccgagaucgccgccagacccaaggugaacggccugggcagcagaauggaguucagcuggacccugcuggacaugugggacaccaucaacuucgagagcaccggcaaccugguggcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacaacgagugcauggacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 155047 - RNA, 1701 nt, Artificial Sequence
  derived and/or modified sequence opt4 from hemagglutinin__InfluenzaA__ACN32283
augaagaccaucaucgcccugagcuacauccugugccuggugagcgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155048 - RNA, 1701 nt, Artificial Sequence
  derived and/or modified sequence opt4 from hemagglutinin__InfluenzaA__ACN32474
augaagaccaucaucgcccugagcuacauccugugccuggugagcgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccaggugcuggacggcgagaacugcacccugaucgacgcccugcugggcgacccccagugcgacggcuuccagaacaagaagugggaccuguucguggagagaagcaaggccuacagcaacugcuaccccuacgacgugcccgacuacaccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacaugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgagguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155049 - RNA, 1698 nt, Artificial Sequence; identical to SEQ ID NO: 155008
  derived and/or modified sequence opt4 from hemagglutinin__InfluenzaA__ACN32501

SEQ ID NO: 155050 - RNA, 1701 nt, Artificial Sequence
  derived and/or modified sequence opt4 from hemagglutinin__InfluenzaA__ACN32534
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacggcaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 155051 - RNA, 1701 nt, Artificial Sequence
  derived and/or modified sequence opt4 from hemagglutinin__InfluenzaA__ACN32545
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccacugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155052 - RNA, 1698 nt, Artificial Sequence
  derived and/or modified sequence opt4 from hemagglutinin__InfluenzaA__ACN32793
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcgagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155053 - RNA, 1698 nt, Artificial Sequence; identical to SEQ ID NO: 154477
  derived and/or modified sequence opt4 from hemagglutinin__InfluenzaA__ACN32804

SEQ ID NO: 155054 - RNA, 1698 nt, Artificial Sequence; identical to SEQ ID NO: 154465
  derived and/or modified sequence opt4 from hemagglutinin__InfluenzaA__ACN32815

SEQ ID NO: 155055 - RNA, 1698 nt, Artificial Sequence; identical to SEQ ID NO: 154475
  derived and/or modified sequence opt4 from hemagglutinin__InfluenzaA__ACN32826

SEQ ID NO: 155056 - RNA, 1701 nt, Artificial Sequence; identical to SEQ ID NO: 154954
  derived and/or modified sequence opt4 from hemagglutinin__InfluenzaA__ACN32848

SEQ ID NO: 155057 - RNA, 1701 nt, Artificial Sequence
  derived and/or modified sequence opt4 from hemagglutinin__InfluenzaA__ACN32870
augaagaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaacugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 155058 - RNA, 1701 nt, Artificial Sequence; identical to SEQ ID NO: 155057
  derived and/or modified sequence opt4 from hemagglutinin__InfluenzaA__ACN32892

SEQ ID NO: 155059 - RNA, 1701 nt, Artificial Sequence; identical to SEQ ID NO: 154954
  derived and/or modified sequence opt4 from hemagglutinin__InfluenzaA__ACN32903

SEQ ID NO: 155060 - RNA, 1701 nt, Artificial Sequence
  derived and/or modified sequence opt4 from hemagglutinin__InfluenzaA__ACN32914
augaagaccaucaucgcccugagcuacauccugugccuggccuucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155061 - RNA, 1701 nt, Artificial Sequence; identical to SEQ ID NO: 154954
  derived and/or modified sequence opt4 from hemagglutinin__InfluenzaA__ACN32925

SEQ ID NO: 155062 - RNA, 1701 nt, Artificial Sequence
  derived and/or modified sequence opt4 from hemagglutinin__InfluenzaA__ACN32936
augaagaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaacugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagaaucaagaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 155063 - RNA, 1701 nt, Artificial Sequence; identical to SEQ ID NO: 154954
  derived and/or modified sequence opt4 from hemagglutinin__InfluenzaA__ACN32947

SEQ ID NO: 155064 - RNA, 1701 nt, Artificial Sequence
  derived and/or modified sequence opt4 from hemagglutinin__InfluenzaA__ACN32958
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaaacaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155065 - RNA, 1701 nt, Artificial Sequence
  derived and/or modified sequence opt4 from hemagglutinin__InfluenzaA__ACN32969
augaagaccaucaucgcccugagcuacauccugugccuggugagcgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccaggugcuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagcugagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgagguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155066 - RNA, 1701 nt, Artificial Sequence
  derived and/or modified sequence opt4 from hemagglutinin__InfluenzaA__ACN32980
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaaguucaaguaccccgcccugaacgugaccaugcccaacgacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcgugggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155067 - RNA, 1701 nt, Artificial Sequence; identical to SEQ ID NO: 154954
  derived and/or modified sequence opt4 from hemagglutinin__InfluenzaA__ACN32991

SEQ ID NO: 155068 - RNA, 1701 nt, Artificial Sequence; identical to SEQ ID NO: 154954
  derived and/or modified sequence opt4 from hemagglutinin__InfluenzaA__ACN33002

SEQ ID NO: 155069 - RNA, 1701 nt, Artificial Sequence; identical to SEQ ID NO: 154954
  derived and/or modified sequence opt4 from hemagglutinin__InfluenzaA__ACN33013

SEQ ID NO: 155070 - RNA, 1701 nt, Artificial Sequence
  derived and/or modified sequence opt4 from hemagglutinin__InfluenzaA__ACN33035
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacguguggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155071 - RNA, 1701 nt, Artificial Sequence; identical to SEQ ID NO: 154954
  derived and/or modified sequence opt4 from hemagglutinin__InfluenzaA__ACN33046

SEQ ID NO: 155072 - RNA, 1701 nt, Artificial Sequence; identical to SEQ ID NO: 154954
  derived and/or modified sequence opt4 from hemagglutinin__InfluenzaA__ACN33057

SEQ ID NO: 155073 - RNA, 1701 nt, Artificial Sequence; identical to SEQ ID NO: 154954
  derived and/or modified sequence opt4 from hemagglutinin__InfluenzaA__ACN33068

SEQ ID NO: 155074 - RNA, 1701 nt, Artificial Sequence; identical to SEQ ID NO: 155057
  derived and/or modified sequence opt4 from hemagglutinin__InfluenzaA__ACN33079

SEQ ID NO: 155075 - RNA, 1698 nt, Artificial Sequence
  derived and/or modified sequence opt4 from hemagglutinin__InfluenzaA__ACN33090
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccaccccagcaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155076 - RNA, 1698 nt, Artificial Sequence; identical to SEQ ID NO: 154434
  derived and/or modified sequence opt4 from hemagglutinin__InfluenzaA__ACN33101

SEQ ID NO: 155077 - RNA, 1701 nt, Artificial Sequence; identical to SEQ ID NO: 155057
  derived and/or modified sequence opt4 from hemagglutinin__InfluenzaA__ACN33112

SEQ ID NO: 155078 - RNA, 1698 nt, Artificial Sequence; identical to SEQ ID NO: 155008
  derived and/or modified sequence opt4 from hemagglutinin__InfluenzaA__ACN33123

SEQ ID NO: 155079 - RNA, 1698 nt, Artificial Sequence; identical to SEQ ID NO: 155008
  derived and/or modified sequence opt4 from hemagglutinin__InfluenzaA__ACN33145

SEQ ID NO: 155080 - RNA, 1701 nt, Artificial Sequence; identical to SEQ ID NO: 154954
  derived and/or modified sequence opt4 from hemagglutinin__InfluenzaA__ACN33156

SEQ ID NO: 155081 - RNA, 1701 nt, Artificial Sequence
  derived and/or modified sequence opt4 from hemagglutinin__InfluenzaA__ACN33178
augaagaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaacugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccacaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 155082 - RNA, 1701 nt, Artificial Sequence; identical to SEQ ID NO: 154954
  derived and/or modified sequence opt4 from hemagglutinin__InfluenzaA__ACN33189

SEQ ID NO: 155083 - RNA, 1701 nt, Artificial Sequence
  derived and/or modified sequence opt4 from hemagglutinin__InfluenzaA__ACN33200
augaagaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaacugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucguggagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 155084 - RNA, 1701 nt, Artificial Sequence
  derived and/or modified sequence opt4 from hemagglutinin__InfluenzaA__ACN33211
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugagcaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155085 - RNA, 1698 nt, Artificial Sequence; identical to SEQ ID NO: 154476
  derived and/or modified sequence opt4 from hemagglutinin__InfluenzaA__ACN42981

SEQ ID NO: 155086 - RNA, 1698 nt, Artificial Sequence; identical to SEQ ID NO: 154710
  derived and/or modified sequence opt4 from hemagglutinin__InfluenzaA__ACN42992

SEQ ID NO: 155087 - RNA, 1701 nt, Artificial Sequence; identical to SEQ ID NO: 154954
  derived and/or modified sequence opt4 from hemagglutinin__InfluenzaA__ACN43003

SEQ ID NO: 155088 - RNA, 1701 nt, Artificial Sequence
  derived and/or modified sequence opt4 from hemagglutinin__InfluenzaA__ACN43014
augaagaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaacugggaccuguucguggagagaagcaaggccuacagcaacugcuaccccuacgacgugcccgacuacgccagccugagaagccugguggccagcagcggcacccuggaguucaacaacgagagcuucaacuggaucggcgugacccagaacggcaccagcagcgccugcaucagaagaagcaacaacagcuucuucagcagacugaacuggcugacccacagcaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcagcugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 155089 - RNA, 1701 nt, Artificial Sequence; identical to SEQ ID NO: 154954
  derived and/or modified sequence opt4 from hemagglutinin__InfluenzaA__ACN43025

SEQ ID NO: 155090 - RNA, 1701 nt, Artificial Sequence; identical to SEQ ID NO: 154954
  derived and/or modified sequence opt4 from hemagglutinin__InfluenzaA__ACN43036

SEQ ID NO: 155091 - RNA, 1701 nt, Artificial Sequence; identical to SEQ ID NO: 154954
  derived and/or modified sequence opt4 from hemagglutinin__InfluenzaA__ACN43047

SEQ ID NO: 155092 - RNA, 1701 nt, Artificial Sequence
  derived and/or modified sequence opt4 from hemagglutinin__InfluenzaA__ACN43058
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcggcagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155093 - RNA, 1701 nt, Artificial Sequence; identical to SEQ ID NO: 154954
  derived and/or modified sequence opt4 from hemagglutinin__InfluenzaA__ACN43069

SEQ ID NO: 155094 - RNA, 1701 nt, Artificial Sequence; identical to SEQ ID NO: 155057
  derived and/or modified sequence opt4 from hemagglutinin__InfluenzaA__ACN43080

SEQ ID NO: 155095 - RNA, 1701 nt, Artificial Sequence
  derived and/or modified sequence opt4 from hemagglutinin__InfluenzaA__ACN72617
auggaggccaagcuguucgugcuguucugcgccuucaccgcccugaaggccgacaccaucugcgugggcuaccacgccaacaacagcaccgacaccguggacaccauccuggagaagaacgugaccgugacccacagcgugaaccugcuggagaacagccacaacggcaagcugugcagccugaacggcaaggccccccugcagcugggcaacugcaacguggccggcuggauccugggcaaccccgagugcgaccugcugcugaccgccaacagcuggagcuacaucaucgagaccagcgacagcaagaacggcgccugcuaccccggcgaguucgccgacuacgaggagcugagagagcagcugagcaccgugagcagcuucgagagauucgagaucuuccccaaggccaccagcuggcccaaccacgagaccaccaagggcaccaccguggccugcagccacagcggcgccaacagcuucuacagaaaccugcuguggaucgugaagaagggcaacagcuaccccaagcugagcaagagcuacaccaacaacaagggcaaggaggugcuggugaucuggggcgugcaccacccccccaccgacagcgaccagcagacccuguaccagaacaagcacaccuacgugagcgugggcagcagcaaguacuaccagagauucacccccgagaucgugaccagacccaaggugagagagcaggccggcagaaugaacuacuacuggacccugcuggaccagggcgacaccaucaccuucgaggccaccggcaaccugaucgcccccuggcacgccuucgcccugaacaagggcagcaacagcggcaucaugaugagcgacgcccacgugcacaacugcaccaccaagugccagaccccccacggcgcccugaagggcaaccugcccuuccagaacgugcaccccaucaccaucggcgagugccccaaguacgugaagagcacccagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacagaaagagcacccagaucgccaucgacggcaucagcaacaaggugaacagcgugaucgagaagaugaacauccaguucaccagcgugggcaaggaguucaacaaccuggagaagagaaucgagaaccugaacaagaagguggacgacggcuuccuggacguguggaccuacaacgccgagcugcugauccugcuggagaacgagagaacccuggacuuccacgacuucaacgugaagaaccuguacgagaaggugaagagccagcugagaaacaacgccaaggagaucggcaacggcugcuucgaguucuaccacaagugcgacaacgagugcauggagagcgugaagaacggcaccuacaacuaccccagauacagcgaggagagcaagcugaacagagaggagaucgacggcgugaagcuggagagcgugggcgugcaccagauccuggccaucuacagcaccguggccagcagccuggugcugcuggugagccugggcgccaucagcuucuggaugugcagcaacggcagccugcagugcagaaucugcaucuga

SEQ ID NO: 155096 - RNA, 1701 nt, Artificial Sequence
  derived and/or modified sequence opt4 from hemagglutinin__InfluenzaA__ACN72632
augaagaccgugaucgcccugagcuacguguucugccugguguucggccaggaccugcccggcaagggcaacaacaccgccacccugugccugggccaccacgccgugcccaacggcacccuggugaagaccaucaccgacgaccagaucgaggugaccaacgccaccgagcuggugcagaacuucagcaucggcaagaucugcaagaacccccacagaauccuggacggcgccaacugcacccugaucgacagccugcugggcgacccccacugcgacggcuuccagaacgagaagugggaccuguucaucgagagaagcaaggccuucagcaacugcuaccccuacgacgugcccgaguacaccagccugagaagccugaucgccagcagcggcacccuggaguucaccaacgaggacuucaacuggaccggcgugacccagaacggcggcagcagcgccugcaagagaggccccaacaacagcuucuucagcagacugaacuggcuguacaagagcggcaacaccuaccccaugcugaacgugaccaugcccaacagcgacgacuucgacaagcuguacaucuggggcgugcaccaccccagcaccgacagagagcagaccaaccuguacauccaggccagcggcaagaucaucgugagcaccaagagaagccagcagaccaucauccccaacaucggcagcagacccugggugagaggccugagcagcagaaucagcaucuacuggaccaucgugaagcccggcgacauccugaucaucaacagcaacggcaaccugaucgcccccagaggcuacuucaagauccagaccggcaagagcagcgugaugagaagcgacgcccccaucggcaccugcaacuacgagugcaucacccccaacggcagcauccccaacgacaagcccuuccagaacgugaacagaaucaccuacggcgccugcccccacuacaucaagcagaacacccugaagcuggccaccggcaugagaaacauccccgagagacagaccagaggcaucuucggcgccaucgccggcuucaucgagaacggcugggagggcauggugaacggcugguacggcuucagacaccagaacagcgagggcaucggccaggccgccgaccugaagagcacccaggccgccaucaaccagaucaacggcaagcugaacagagugaucgagaagaccaacgagaaguuccaccagaucgagaaggaguucagcgagguggagggcagaauccaggaccuggagagauacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacagcugcauggagagcaucagaaacggcaccuacgaccacaacgaguacagagacgaggccgugaacaacagauuccagaucaagagcguggagcugaagagcggcuacaaggacuggauccuguggaucagcuucgccaucagcugcuuccugcugugcgccguguggcugggcuucaucaucugggccugccagaagggcaacaucagaugcaacaucugcaucuga

SEQ ID NO: 155097 - RNA, 1701 nt, Artificial Sequence; identical to SEQ ID NO: 154954
  derived and/or modified sequence opt4 from hemagglutinin__InfluenzaA__ACN76478

SEQ ID NO: 155098 - RNA, 1701 nt, Artificial Sequence
  derived and/or modified sequence opt4 from hemagglutinin__InfluenzaA__ACN76489
augaagaccaucaucgcccugggcuacauccugugccuggugagcgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccaggugcuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgagguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155099 - RNA, 1701 nt, Artificial Sequence; identical to SEQ ID NO: 154954
  derived and/or modified sequence opt4 from hemagglutinin__InfluenzaA__ACN76500

SEQ ID NO: 155100 - RNA, 1701 nt, Artificial Sequence; identical to SEQ ID NO: 154954
  derived and/or modified sequence opt4 from hemagglutinin__InfluenzaA__ACN76511

SEQ ID NO: 155101 - RNA, 1701 nt, Artificial Sequence; identical to SEQ ID NO: 154954
  derived and/or modified sequence opt4 from hemagglutinin__InfluenzaA__ACN76522

SEQ ID NO: 155102 - RNA, 1701 nt, Artificial Sequence; identical to SEQ ID NO: 154954
  derived and/or modified sequence opt4 from hemagglutinin__InfluenzaA__ACO36331

SEQ ID NO: 155103 - RNA, 1701 nt, Artificial Sequence
  derived and/or modified sequence opt4 from hemagglutinin__InfluenzaA__ACO36342
augaagaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaacugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagaucgagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 155104 - RNA, 1701 nt, Artificial Sequence
  derived and/or modified sequence opt4 from hemagglutinin__InfluenzaA__ACO36364
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155105 - RNA, 1701 nt, Artificial Sequence; identical to SEQ ID NO: 154821
  derived and/or modified sequence opt4 from hemagglutinin__InfluenzaA__ACO36375

SEQ ID NO: 155106 - RNA, 1698 nt, Artificial Sequence; identical to SEQ ID NO: 155008
  derived and/or modified sequence opt4 from hemagglutinin__InfluenzaA__ACO36397

SEQ ID NO: 155107 - RNA, 1701 nt, Artificial Sequence; identical to SEQ ID NO: 154821
  derived and/or modified sequence opt4 from hemagglutinin__InfluenzaA__ACO36408

SEQ ID NO: 155108 - RNA, 1701 nt, Artificial Sequence; identical to SEQ ID NO: 154448
  derived and/or modified sequence opt4 from hemagglutinin__InfluenzaA__ACO36419

SEQ ID NO: 155109 - RNA, 1701 nt, Artificial Sequence; identical to SEQ ID NO: 154448
  derived and/or modified sequence opt4 from hemagglutinin__InfluenzaA__ACO36430

SEQ ID NO: 155110 - RNA, 1701 nt, Artificial Sequence
  derived and/or modified sequence opt4 from hemagglutinin__InfluenzaA__ACO36441
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcgacaucugcaucuga

SEQ ID NO: 155111 - RNA, 1701 nt, Artificial Sequence
  derived and/or modified sequence opt4 from hemagglutinin__InfluenzaA__ACO36452
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcagcugcaagagaagaagcaacaacagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccaucagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155112 - RNA, 1701 nt, Artificial Sequence
  derived and/or modified sequence opt4 from hemagglutinin__InfluenzaA__ACO36463
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugccagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccagaccagcggcagaaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuucgugcugugcguggcccugcugggcuucaucaugugggccugccagaagggcaacaucagaugcaacaucugcaucuga

SEQ ID NO: 155113 - RNA, 1701 nt, Artificial Sequence
  derived and/or modified sequence opt4 from hemagglutinin__InfluenzaA__ACO36474
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcagcugcaagagaagaagcaacaacagcuucuucagcagacugaacuggcugacccaccugagauacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgacugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155114 - RNA, 1701 nt, Artificial Sequence
  derived and/or modified sequence opt4 from hemagglutinin__InfluenzaA__ACO36496
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacggcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagacccagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155115 - RNA, 1701 nt, Artificial Sequence
  derived and/or modified sequence opt4 from hemagglutinin__InfluenzaA__ACO36518
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcaccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagcugggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155116 - RNA, 1701 nt, Artificial Sequence
  derived and/or modified sequence opt4 from hemagglutinin__InfluenzaA__ACO36551
augaagaccaucaucgcccugagccacauccugugccugguguucgcccagaagccccccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagacccagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacgagaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155117 - RNA, 1701 nt, Artificial Sequence
  derived and/or modified sequence opt4 from hemagglutinin__InfluenzaA__ACO36562
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagacccagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacgagaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155118 - RNA, 1701 nt, Artificial Sequence
  derived and/or modified sequence opt4 from hemagglutinin__InfluenzaA__ACO36573
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagacccagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacgagaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155119 - RNA, 1701 nt, Artificial Sequence
  derived and/or modified sequence opt4 from hemagglutinin__InfluenzaA__ACO36584
augaagaccaucaucgcccugagcuacauccugugccugguguucagccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagaagagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagacccagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacgagaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155120 - RNA, 1701 nt, Artificial Sequence; identical to SEQ ID NO: 153150
  derived and/or modified sequence opt4 from hemagglutinin__InfluenzaA__ACO36595

SEQ ID NO: 155121 - RNA, 1701 nt, Artificial Sequence
  derived and/or modified sequence opt4 from hemagglutinin__InfluenzaA__ACO36606
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaagaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcacccagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155122 - RNA, 1701 nt, Artificial Sequence; identical to SEQ ID NO: 153150
  derived and/or modified sequence opt4 from hemagglutinin__InfluenzaA__ACO36617

SEQ ID NO: 155123 - RNA, 1701 nt, Artificial Sequence; identical to SEQ ID NO: 153150
  derived and/or modified sequence opt4 from hemagglutinin__InfluenzaA__ACO36628

SEQ ID NO: 155124 - RNA, 1701 nt, Artificial Sequence
  derived and/or modified sequence opt4 from hemagglutinin__InfluenzaA__ACO36639
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcuucgcccugcugggcuucaucaugugggccugccagaagggcaacaucagaugcaacaucugcaucuga

SEQ ID NO: 155125 - RNA, 1701 nt, Artificial Sequence
  derived and/or modified sequence opt4 from hemagglutinin__InfluenzaA__ACO36661
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaucaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155126 - RNA, 1701 nt, Artificial Sequence; identical to SEQ ID NO: 153150
  derived and/or modified sequence opt4 from hemagglutinin__InfluenzaA__ACO36683

SEQ ID NO: 155127 - RNA, 1701 nt, Artificial Sequence; identical to SEQ ID NO: 155117
  derived and/or modified sequence opt4 from hemagglutinin__InfluenzaA__ACO37122

SEQ ID NO: 155128 - RNA, 1701 nt, Artificial Sequence
  derived and/or modified sequence opt4 from hemagglutinin__InfluenzaA__ACO94514
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155129 - RNA, 1701 nt, Artificial Sequence
  derived and/or modified sequence opt4 from hemagglutinin__InfluenzaA__ACO94515
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155130 - RNA, 1701 nt, Artificial Sequence; identical to SEQ ID NO: 154954
  derived and/or modified sequence opt4 from hemagglutinin__InfluenzaA__ACO94516

SEQ ID NO: 155131 - RNA, 1701 nt, Artificial Sequence; identical to SEQ ID NO: 154954
  derived and/or modified sequence opt4 from hemagglutinin__InfluenzaA__ACO94672

SEQ ID NO: 155132 - RNA, 1701 nt, Artificial Sequence
  derived and/or modified sequence opt4 from hemagglutinin__InfluenzaA__ACO94683
augaagaccaucaucgcccugagcuacauccugugccuggugagcgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccaggugcuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucaccgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgagguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155133 - RNA, 1701 nt, Artificial Sequence; identical to SEQ ID NO: 154954
  derived and/or modified sequence opt4 from hemagglutinin__InfluenzaA__ACO94694

SEQ ID NO: 155134 - RNA, 1698 nt, Artificial Sequence; identical to SEQ ID NO: 155008
  derived and/or modified sequence opt4 from hemagglutinin__InfluenzaA__ACO94705

SEQ ID NO: 155135 - RNA, 1701 nt, Artificial Sequence
  derived and/or modified sequence opt4 from hemagglutinin__InfluenzaA__ACO94727
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugaagagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugccugcugcugugcguggcccugcugggcuucaucaugugggccugccagaagggcaacaucagaugcaacaucugcaucuga

SEQ ID NO: 155136 - RNA, 1701 nt, Artificial Sequence
  derived and/or modified sequence opt4 from hemagglutinin__InfluenzaA__ACO94738
augaagaccaucaucgcccugagcuacauccagugccugguguucgcccagaaguuccccggcaacgacaacagcaccgccacccugugccugggccaccacgccgugcccaacggcaccguggugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaacugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgagaacuucgacaagcuguacaucuggggcgugcaccaccccggcaccgacaacgaccagaucuuccuguacgccagagccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 155137 - RNA, 1701 nt, Artificial Sequence; identical to SEQ ID NO: 155057
  derived and/or modified sequence opt4 from hemagglutinin__InfluenzaA__ACO94760

SEQ ID NO: 155138 - RNA, 1701 nt, Artificial Sequence
  derived and/or modified sequence opt4 from hemagglutinin__InfluenzaA__ACO94771
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugccugcugcugugcguggcccugcugggcuucaucaugugggccugccagaagggcaacaucagaugcaacaucugcaucuga

SEQ ID NO: 155139 - RNA, 1701 nt, Artificial Sequence; identical to SEQ ID NO: 154954
  derived and/or modified sequence opt4 from hemagglutinin__InfluenzaA__ACO94782

SEQ ID NO: 155140 - RNA, 1701 nt, Artificial Sequence; identical to SEQ ID NO: 154954
  derived and/or modified sequence opt4 from hemagglutinin__InfluenzaA__ACO94793

SEQ ID NO: 155141 - RNA, 1698 nt, Artificial Sequence
  derived and/or modified sequence opt4 from hemagglutinin__InfluenzaA__ACO94804
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcagagagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccaccaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcaaccagagagcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacggcugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcuacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155142 - RNA, 1701 nt, Artificial Sequence; identical to SEQ ID NO: 154821
  derived and/or modified sequence opt4 from hemagglutinin__InfluenzaA__ACO94815

SEQ ID NO: 155143 - RNA, 1701 nt, Artificial Sequence; identical to SEQ ID NO: 154828
  derived and/or modified sequence opt4 from hemagglutinin__InfluenzaA__ACO94848

SEQ ID NO: 155144 - RNA, 1698 nt, Artificial Sequence; identical to SEQ ID NO: 155008
  derived and/or modified sequence opt4 from hemagglutinin__InfluenzaA__ACO94859

SEQ ID NO: 155145 - RNA, 1698 nt, Artificial Sequence
  derived and/or modified sequence opt4 from hemagglutinin__InfluenzaA__ACO94870
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaagggcaaggaggugcuggugcuguggggcgugcaccacccccccaacaucggcgaccagaacacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugaacagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155146 - RNA, 1701 nt, Artificial Sequence
  derived and/or modified sequence opt4 from hemagglutinin__InfluenzaA__ACO94881
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcagcugcaagagaagaagcaacaacagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacagaugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155147 - RNA, 1701 nt, Artificial Sequence
  derived and/or modified sequence opt4 from hemagglutinin__InfluenzaA__ACO94892
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugccagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccagaccagcggcagaaucaccaucagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgugaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155148 - RNA, 1701 nt, Artificial Sequence
  derived and/or modified sequence opt4 from hemagglutinin__InfluenzaA__ACO94903
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcgaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155149 - RNA, 1701 nt, Artificial Sequence
  derived and/or modified sequence opt4 from hemagglutinin__InfluenzaA__ACO94925
augaagaccaucaucgcccugagcuacauccugugccugguguucgcccagaagcugcccggcaacgacaacagcaccgccacccugugccugggccaccacgccgugcccaacggcaccguggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155150 - RNA, 1701 nt, Artificial Sequence
  derived and/or modified sequence opt4 from hemagglutinin__InfluenzaA__ACO94936
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgaggacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcagcugcaagagaagaagcaacaacagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155151 - RNA, 1701 nt, Artificial Sequence
  derived and/or modified sequence opt4 from hemagglutinin__InfluenzaA__ACO94947
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucagaaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155152 - RNA, 1701 nt, Artificial Sequence
  derived and/or modified sequence opt4 from hemagglutinin__InfluenzaA__ACO95153
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaacuucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagacccagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155153 - RNA, 1701 nt, Artificial Sequence; identical to SEQ ID NO: 155118
  derived and/or modified sequence opt4 from hemagglutinin__InfluenzaA__ACO95171

SEQ ID NO: 155154 - RNA, 1701 nt, Artificial Sequence
  derived and/or modified sequence opt4 from hemagglutinin__InfluenzaA__ACO95193
augaagaccaucaucgcccugagcuacauccugugccugguguucgcccagaagcugcccggcaacgacaagagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagaacuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagacccagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155155 - RNA, 1701 nt, Artificial Sequence; identical to SEQ ID NO: 155117
  derived and/or modified sequence opt4 from hemagglutinin__InfluenzaA__ACO95204

SEQ ID NO: 155156 - RNA, 1701 nt, Artificial Sequence
  derived and/or modified sequence opt4 from hemagglutinin__InfluenzaA__ACO95215
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagacccagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacgagaccuacgaccacgacguguacagagacgaggcccugaacaacagauuccagaucaagagcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155157 - RNA, 1701 nt, Artificial Sequence; identical to SEQ ID NO: 152801
  derived and/or modified sequence opt4 from hemagglutinin__InfluenzaA__ACO95226

SEQ ID NO: 155158 - RNA, 1701 nt, Artificial Sequence; identical to SEQ ID NO: 153150
  derived and/or modified sequence opt4 from hemagglutinin__InfluenzaA__ACO95248

SEQ ID NO: 155159 - RNA, 1701 nt, Artificial Sequence
  derived and/or modified sequence opt4 from hemagglutinin__InfluenzaA__ACO95270
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagaaguucgacaagcuguacaucuggggcgugcaccaccccgugaccgacaacaaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155160 - RNA, 1701 nt, Artificial Sequence; identical to SEQ ID NO: 154954
  derived and/or modified sequence opt4 from hemagglutinin__InfluenzaA__ACO95281

SEQ ID NO: 155161 - RNA, 1701 nt, Artificial Sequence
  derived and/or modified sequence opt4 from hemagglutinin__InfluenzaA__ACO95292
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155162 - RNA, 1701 nt, Artificial Sequence; identical to SEQ ID NO: 155057
  derived and/or modified sequence opt4 from hemagglutinin__InfluenzaA__ACO95303

SEQ ID NO: 155163 - RNA, 1698 nt, Artificial Sequence
  derived and/or modified sequence opt4 from hemagglutinin__InfluenzaA__ACO95382
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagggcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155164 - RNA, 1698 nt, Artificial Sequence
  derived and/or modified sequence opt4 from hemagglutinin__InfluenzaA__ACO95415
augaaggugaagcugcuggugcugcugugcaccuucaccgccaccuacgccgacaccaucugcaucggcuaccacgccaacaacagcaccgacaccaucgacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaagggcaaggaggugcuggugcuguggggcgugcaccacccccccaacaucggcgaccagaacacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155165 - RNA, 1701 nt, Artificial Sequence
  derived and/or modified sequence opt4 from hemagglutinin__InfluenzaA__ACO95426
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcagcugcaagagaagaagcaacaacagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155166 - RNA, 1701 nt, Artificial Sequence; identical to SEQ ID NO: 154315
  derived and/or modified sequence opt4 from hemagglutinin__InfluenzaA__ACO95437

SEQ ID NO: 155167 - RNA, 1701 nt, Artificial Sequence
  derived and/or modified sequence opt4 from hemagglutinin__InfluenzaA__ACO95448
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucaaccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155168 - RNA, 1701 nt, Artificial Sequence; identical to SEQ ID NO: 153150
  derived and/or modified sequence opt4 from hemagglutinin__InfluenzaA__ACO95459

SEQ ID NO: 155169 - RNA, 1701 nt, Artificial Sequence
  derived and/or modified sequence opt4 from hemagglutinin__InfluenzaA__ACO95470
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcagaugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155170 - RNA, 1701 nt, Artificial Sequence
  derived and/or modified sequence opt4 from hemagglutinin__InfluenzaA__ACO95481
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaaccugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155171 - RNA, 1701 nt, Artificial Sequence; identical to SEQ ID NO: 153150
  derived and/or modified sequence opt4 from hemagglutinin__InfluenzaA__ACO95492

SEQ ID NO: 155172 - RNA, 1701 nt, Artificial Sequence; identical to SEQ ID NO: 153150
  derived and/or modified sequence opt4 from hemagglutinin__InfluenzaA__ACO95503

SEQ ID NO: 155173 - RNA, 1701 nt, Artificial Sequence; identical to SEQ ID NO: 153150
  derived and/or modified sequence opt4 from hemagglutinin__InfluenzaA__ACO95514

SEQ ID NO: 155174 - RNA, 1701 nt, Artificial Sequence; identical to SEQ ID NO: 153150
  derived and/or modified sequence opt4 from hemagglutinin__InfluenzaA__ACO95536

SEQ ID NO: 155175 - RNA, 1701 nt, Artificial Sequence; identical to SEQ ID NO: 153150
  derived and/or modified sequence opt4 from hemagglutinin__InfluenzaA__ACO95547

SEQ ID NO: 155176 - RNA, 1701 nt, Artificial Sequence
  derived and/or modified sequence opt4 from hemagglutinin__InfluenzaA__ACP41963
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155177 - RNA, 1698 nt, Artificial Sequence; identical to SEQ ID NO: 155163
  derived and/or modified sequence opt4 from hemagglutinin__InfluenzaA__ACP44192

SEQ ID NO: 155178 - RNA, 1698 nt, Artificial Sequence; identical to SEQ ID NO: 155163
  derived and/or modified sequence opt4 from hemagglutinin__InfluenzaA__ACP44203

SEQ ID NO: 155179 - RNA, 1698 nt, Artificial Sequence
  derived and/or modified sequence opt4 from hemagglutinin__InfluenzaA__ACP44225
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcggccugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcaaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155180 - RNA, 1701 nt, Artificial Sequence
  derived and/or modified sequence opt4 from hemagglutinin__InfluenzaA__ACP44236
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcgacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155181 - RNA, 1701 nt, Artificial Sequence; identical to SEQ ID NO: 155117
  derived and/or modified sequence opt4 from hemagglutinin__InfluenzaA__ACP44247

SEQ ID NO: 155182 - RNA, 1701 nt, Artificial Sequence; identical to SEQ ID NO: 153150
  derived and/or modified sequence opt4 from hemagglutinin__InfluenzaA__ACP44258

SEQ ID NO: 155183 - RNA, 1701 nt, Artificial Sequence; identical to SEQ ID NO: 153150
  derived and/or modified sequence opt4 from hemagglutinin__InfluenzaA__ACP44269

SEQ ID NO: 155184 - RNA, 1701 nt, Artificial Sequence; identical to SEQ ID NO: 155176
  derived and/or modified sequence opt4 from hemagglutinin__InfluenzaA__ACQ44554

SEQ ID NO: 155185 - RNA, 1701 nt, Artificial Sequence; identical to SEQ ID NO: 155176
  derived and/or modified sequence opt4 from hemagglutinin__InfluenzaA__ACQ44556

SEQ ID NO: 155186 - RNA, 1701 nt, Artificial Sequence; identical to SEQ ID NO: 155176
  derived and/or modified sequence opt4 from hemagglutinin__InfluenzaA__ACQ45338

SEQ ID NO: 155187 - RNA, 1701 nt, Artificial Sequence
  derived and/or modified sequence opt4 from hemagglutinin__InfluenzaA__ACQ55359
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155188 - RNA, 1701 nt, Artificial Sequence; identical to SEQ ID NO: 155176
  derived and/or modified sequence opt4 from hemagglutinin__InfluenzaA__ACQ55361

SEQ ID NO: 155189 - RNA, 1701 nt, Artificial Sequence
  derived and/or modified sequence opt4 from hemagglutinin__InfluenzaA__ACQ63223
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155190 - RNA, 1701 nt, Artificial Sequence; identical to SEQ ID NO: 155189
  derived and/or modified sequence opt4 from hemagglutinin__InfluenzaA__ACQ63239

SEQ ID NO: 155191 - RNA, 1701 nt, Artificial Sequence; identical to SEQ ID NO: 155189
  derived and/or modified sequence opt4 from hemagglutinin__InfluenzaA__ACQ63244

SEQ ID NO: 155192 - RNA, 1701 nt, Artificial Sequence; identical to SEQ ID NO: 155189
  derived and/or modified sequence opt4 from hemagglutinin__InfluenzaA__ACQ63257

SEQ ID NO: 155193 - RNA, 1701 nt, Artificial Sequence
  derived and/or modified sequence opt4 from hemagglutinin__InfluenzaA__ACQ65691
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcagcugcaagagaggcagcgacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccccuacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucaccaucagcugcuuccugcugugcguggcccugcugggcuucaucaugugggccugccagaagggcaacaucagaugcaacaucugcaucuga

SEQ ID NO: 155194 - RNA, 1701 nt, Artificial Sequence; identical to SEQ ID NO: 154954
  derived and/or modified sequence opt4 from hemagglutinin__InfluenzaA__ACQ65713

SEQ ID NO: 155195 - RNA, 1701 nt, Artificial Sequence
  derived and/or modified sequence opt4 from hemagglutinin__InfluenzaA__ACQ65724
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155196 - RNA, 1701 nt, Artificial Sequence
  derived and/or modified sequence opt4 from hemagglutinin__InfluenzaA__ACQ65747
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaaccaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaucggccaggccgccgaccugaagagcacccaggccgccaucgaccagaucaacggcaagcugaacggccugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155197 - RNA, 1698 nt, Artificial Sequence
  derived and/or modified sequence opt4 from hemagglutinin__InfluenzaA__ACQ65758
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacgugguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaagggcaaggaggugcuggugcuguggggcgugcaccacccccccaacaucggcgaccagaacacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155198 - RNA, 1701 nt, Artificial Sequence; identical to SEQ ID NO: 155176
  derived and/or modified sequence opt4 from hemagglutinin__InfluenzaA__ACQ73386

SEQ ID NO: 155199 - RNA, 1701 nt, Artificial Sequence; identical to SEQ ID NO: 155189
  derived and/or modified sequence opt4 from hemagglutinin__InfluenzaA__ACQ73387

SEQ ID NO: 155200 - RNA, 1701 nt, Artificial Sequence
  derived and/or modified sequence opt4 from hemagglutinin__InfluenzaA__ACQ73555
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaagcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155201 - RNA, 1701 nt, Artificial Sequence; identical to SEQ ID NO: 155189
  derived and/or modified sequence opt4 from hemagglutinin__InfluenzaA__ACQ76294

SEQ ID NO: 155202 - RNA, 1701 nt, Artificial Sequence; identical to SEQ ID NO: 155189
  derived and/or modified sequence opt4 from hemagglutinin__InfluenzaA__ACQ76314

SEQ ID NO: 155203 - RNA, 1701 nt, Artificial Sequence; identical to SEQ ID NO: 155189
  derived and/or modified sequence opt4 from hemagglutinin__InfluenzaA__ACQ76317

SEQ ID NO: 155204 - RNA, 1701 nt, Artificial Sequence
  derived and/or modified sequence opt4 from hemagglutinin__InfluenzaA__ACQ76318
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155205 - RNA, 1701 nt, Artificial Sequence; identical to SEQ ID NO: 155176
  derived and/or modified sequence opt4 from hemagglutinin__InfluenzaA__ACQ76326

SEQ ID NO: 155206 - RNA, 1701 nt, Artificial Sequence; identical to SEQ ID NO: 155176
  derived and/or modified sequence opt4 from hemagglutinin__InfluenzaA__ACQ76336

SEQ ID NO: 155207 - RNA, 1701 nt, Artificial Sequence; identical to SEQ ID NO: 155176
  derived and/or modified sequence opt4 from hemagglutinin__InfluenzaA__ACQ76347

SEQ ID NO: 155208 - RNA, 1701 nt, Artificial Sequence; identical to SEQ ID NO: 155189
  derived and/or modified sequence opt4 from hemagglutinin__InfluenzaA__ACQ76365

SEQ ID NO: 155209 - RNA, 1701 nt, Artificial Sequence; identical to SEQ ID NO: 155189
  derived and/or modified sequence opt4 from hemagglutinin__InfluenzaA__ACQ76370

SEQ ID NO: 155210 - RNA, 1701 nt, Artificial Sequence; identical to SEQ ID NO: 155176
  derived and/or modified sequence opt4 from hemagglutinin__InfluenzaA__ACQ76376

SEQ ID NO: 155211 - RNA, 1701 nt, Artificial Sequence
  derived and/or modified sequence opt4 from hemagglutinin__InfluenzaA__ACQ76383
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcaucaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155212 - RNA, 1701 nt, Artificial Sequence; identical to SEQ ID NO: 155189
  derived and/or modified sequence opt4 from hemagglutinin__InfluenzaA__ACQ76389

SEQ ID NO: 155213 - RNA, 1701 nt, Artificial Sequence; identical to SEQ ID NO: 155176
  derived and/or modified sequence opt4 from hemagglutinin__InfluenzaA__ACQ76401

SEQ ID NO: 155214 - RNA, 1701 nt, Artificial Sequence; identical to SEQ ID NO: 155189
  derived and/or modified sequence opt4 from hemagglutinin__InfluenzaA__ACQ76405

SEQ ID NO: 155215 - RNA, 1701 nt, Artificial Sequence
  derived and/or modified sequence opt4 from hemagglutinin__InfluenzaA__ACQ76408
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155216 - RNA, 1701 nt, Artificial Sequence
  derived and/or modified sequence opt4 from hemagglutinin__InfluenzaA__ACQ77601
augaagaccaucaucgcccugagcuacauccugugccuggccuucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcgacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcuggagaacagauaccccgcccccaacgugaccaugcccaacaacgacaaguucgacaagcuguacaucuggggcgugcaccaccccagcaccgacagcgaccagaucagcguguacgcccaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacaagcugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 155217 - RNA, 1701 nt, Artificial Sequence
  derived and/or modified sequence opt4 from hemagglutinin__InfluenzaA__ACQ83310
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcaugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaagcugaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155218 - RNA, 1701 nt, Artificial Sequence; identical to SEQ ID NO: 155176
  derived and/or modified sequence opt4 from hemagglutinin__InfluenzaA__ACQ84451

SEQ ID NO: 155219 - RNA, 1701 nt, Artificial Sequence; identical to SEQ ID NO: 155176
  derived and/or modified sequence opt4 from hemagglutinin__InfluenzaA__ACQ84457

SEQ ID NO: 155220 - RNA, 1701 nt, Artificial Sequence
  derived and/or modified sequence opt4 from hemagglutinin__InfluenzaA__ACQ84477
augaaggccauccugcuggugcugcuguacaccuucaccgccgccaacgccgacacccugugcaucggcuaccacgccaacaacagcaccgacaccguggacaccgugcuggagaagaacgugaccgugacccacagcgugaaccugcuggaggacagacacaacggcaagcugugcaagcugagaggcguggccccccugcaccugggcaagugcaacaucgccggcuggcugcugggcaaccccgagugcgagcugcuguucaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaaggccagcagcuggcccgaccacgagaccaacagaggcgugaccgccgccugccccuacgccggcgccaacagcuucuacagaaaccugaucuggcuggugaagaagggcaacagcuaccccaagcugagcaagagcuacgugaacaacaaggagaaggaggugcuggugcuguggggcauccaccacccccccaccagcaccgaccagcagagccuguaccagaacgccgacgccuacguguucgugggcagcagcaaguacaacaagaaguucaagcccgagaucgccaccagacccaaggugagaggccaggccggcagaaugaacuacuacuggacccugguggagcccggcgacaccaucaccuucgaggccaccggcaaccugguggugcccagauacgccuucgccaugaagagaggcagcggcagcggcaucaucaucagcgacacccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacguguggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaccugcauggagagcgugaagaacggcaccuacgacuaccccaaguacagcgaggagagcaagcugaacagagaggagaucgacggcgugaagcuggagagcaccagaaucuaccagauccuggccaucuacagcaccguggccagcagccuggugcugcuggugagccugggcgccaucagcuucuggaugugcagcaacggcagccugcagugcagaaucugcaucuga

SEQ ID NO: 155221 - RNA, 1701 nt, Artificial Sequence
  derived and/or modified sequence opt4 from hemagglutinin__InfluenzaA__ACQ89900
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugguggagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155222 - RNA, 1701 nt, Artificial Sequence; identical to SEQ ID NO: 155189
  derived and/or modified sequence opt4 from hemagglutinin__InfluenzaA__ACQ89902

SEQ ID NO: 155223 - RNA, 1701 nt, Artificial Sequence
  derived and/or modified sequence opt4 from hemagglutinin__InfluenzaA__ACQ89904
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaagggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155224 - RNA, 1701 nt, Artificial Sequence; identical to SEQ ID NO: 155221
  derived and/or modified sequence opt4 from hemagglutinin__InfluenzaA__ACQ89905

SEQ ID NO: 155225 - RNA, 1701 nt, Artificial Sequence; identical to SEQ ID NO: 155176
  derived and/or modified sequence opt4 from hemagglutinin__InfluenzaA__ACQ99607

SEQ ID NO: 155226 - RNA, 1701 nt, Artificial Sequence; identical to SEQ ID NO: 155176
  derived and/or modified sequence opt4 from hemagglutinin__InfluenzaA__ACQ99608

SEQ ID NO: 155227 - RNA, 1701 nt, Artificial Sequence; identical to SEQ ID NO: 155176
  derived and/or modified sequence opt4 from hemagglutinin__InfluenzaA__ACQ99609

SEQ ID NO: 155228 - RNA, 1701 nt, Artificial Sequence; identical to SEQ ID NO: 155176
  derived and/or modified sequence opt4 from hemagglutinin__InfluenzaA__ACQ99611

SEQ ID NO: 155229 - RNA, 1701 nt, Artificial Sequence
  derived and/or modified sequence opt4 from hemagglutinin__InfluenzaA__ACQ99614
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcugauccugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155230 - RNA, 1701 nt, Artificial Sequence; identical to SEQ ID NO: 155229
  derived and/or modified sequence opt4 from hemagglutinin__InfluenzaA__ACQ99616

SEQ ID NO: 155231 - RNA, 1701 nt, Artificial Sequence; identical to SEQ ID NO: 155176
  derived and/or modified sequence opt4 from hemagglutinin__InfluenzaA__ACQ99617

SEQ ID NO: 155232 - RNA, 1701 nt, Artificial Sequence; identical to SEQ ID NO: 155176
  derived and/or modified sequence opt4 from hemagglutinin__InfluenzaA__ACQ99618

SEQ ID NO: 155233 - RNA, 1701 nt, Artificial Sequence; identical to SEQ ID NO: 155176
  derived and/or modified sequence opt4 from hemagglutinin__InfluenzaA__ACQ99619

SEQ ID NO: 155234 - RNA, 1701 nt, Artificial Sequence; identical to SEQ ID NO: 155176
  derived and/or modified sequence opt4 from hemagglutinin__InfluenzaA__ACQ99620

SEQ ID NO: 155235 - RNA, 1701 nt, Artificial Sequence; identical to SEQ ID NO: 155229
  derived and/or modified sequence opt4 from hemagglutinin__InfluenzaA__ACQ99621

SEQ ID NO: 155236 - RNA, 1701 nt, Artificial Sequence; identical to SEQ ID NO: 155176
  derived and/or modified sequence opt4 from hemagglutinin__InfluenzaA__ACQ99622

SEQ ID NO: 155237 - RNA, 1701 nt, Artificial Sequence
  derived and/or modified sequence opt4 from hemagglutinin__InfluenzaA__ACR01014
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaauggagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155238 - RNA, 1701 nt, Artificial Sequence; identical to SEQ ID NO: 155189
  derived and/or modified sequence opt4 from hemagglutinin__InfluenzaA__ACR08419

SEQ ID NO: 155239 - RNA, 1701 nt, Artificial Sequence
  derived and/or modified sequence opt4 from hemagglutinin__InfluenzaA__ACR08429
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacaccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155240 - RNA, 1701 nt, Artificial Sequence; identical to SEQ ID NO: 155189
  derived and/or modified sequence opt4 from hemagglutinin__InfluenzaA__ACR08439

SEQ ID NO: 155241 - RNA, 1701 nt, Artificial Sequence; identical to SEQ ID NO: 155189
  derived and/or modified sequence opt4 from hemagglutinin__InfluenzaA__ACR08449

SEQ ID NO: 155242 - RNA, 1701 nt, Artificial Sequence
  derived and/or modified sequence opt4 from hemagglutinin__InfluenzaA__ACR08459
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcgacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155243 - RNA, 1701 nt, Artificial Sequence; identical to SEQ ID NO: 155176
  derived and/or modified sequence opt4 from hemagglutinin__InfluenzaA__ACR08528

SEQ ID NO: 155244 - RNA, 1701 nt, Artificial Sequence; identical to SEQ ID NO: 155176
  derived and/or modified sequence opt4 from hemagglutinin__InfluenzaA__ACR08530

SEQ ID NO: 155245 - RNA, 1701 nt, Artificial Sequence; identical to SEQ ID NO: 155242
  derived and/or modified sequence opt4 from hemagglutinin__InfluenzaA__ACR08531

SEQ ID NO: 155246 - RNA, 1701 nt, Artificial Sequence; identical to SEQ ID NO: 155189
  derived and/or modified sequence opt4 from hemagglutinin__InfluenzaA__ACR08533

SEQ ID NO: 155247 - RNA, 1701 nt, Artificial Sequence; identical to SEQ ID NO: 155242
  derived and/or modified sequence opt4 from hemagglutinin__InfluenzaA__ACR08535

SEQ ID NO: 155248 - RNA, 1701 nt, Artificial Sequence; identical to SEQ ID NO: 155189
  derived and/or modified sequence opt4 from hemagglutinin__InfluenzaA__ACR08536

SEQ ID NO: 155249 - RNA, 1701 nt, Artificial Sequence; identical to SEQ ID NO: 155242
  derived and/or modified sequence opt4 from hemagglutinin__InfluenzaA__ACR08537

SEQ ID NO: 155250 - RNA, 1701 nt, Artificial Sequence; identical to SEQ ID NO: 155242
  derived and/or modified sequence opt4 from hemagglutinin__InfluenzaA__ACR08538

SEQ ID NO: 155251 - RNA, 1701 nt, Artificial Sequence; identical to SEQ ID NO: 155189
  derived and/or modified sequence opt4 from hemagglutinin__InfluenzaA__ACR08539

SEQ ID NO: 155252 - RNA, 1701 nt, Artificial Sequence; identical to SEQ ID NO: 155189
  derived and/or modified sequence opt4 from hemagglutinin__InfluenzaA__ACR08540

SEQ ID NO: 155253 - RNA, 1701 nt, Artificial Sequence; identical to SEQ ID NO: 155176
  derived and/or modified sequence opt4 from hemagglutinin__InfluenzaA__ACR08542

SEQ ID NO: 155254 - RNA, 1701 nt, Artificial Sequence; identical to SEQ ID NO: 155176
  derived and/or modified sequence opt4 from hemagglutinin__InfluenzaA__ACR08543

SEQ ID NO: 155255 - RNA, 1701 nt, Artificial Sequence; identical to SEQ ID NO: 155215
  derived and/or modified sequence opt4 from hemagglutinin__InfluenzaA__ACR08544

SEQ ID NO: 155256 - RNA, 1701 nt, Artificial Sequence; identical to SEQ ID NO: 155242
  derived and/or modified sequence opt4 from hemagglutinin__InfluenzaA__ACR08545

SEQ ID NO: 155257 - RNA, 1701 nt, Artificial Sequence; identical to SEQ ID NO: 155176
  derived and/or modified sequence opt4 from hemagglutinin__InfluenzaA__ACR08546

SEQ ID NO: 155258 - RNA, 1701 nt, Artificial Sequence; identical to SEQ ID NO: 155189
  derived and/or modified sequence opt4 from hemagglutinin__InfluenzaA__ACR08547

SEQ ID NO: 155259 - RNA, 1701 nt, Artificial Sequence; identical to SEQ ID NO: 155242
  derived and/or modified sequence opt4 from hemagglutinin__InfluenzaA__ACR08548

SEQ ID NO: 155260 - RNA, 1701 nt, Artificial Sequence; identical to SEQ ID NO: 155189
  derived and/or modified sequence opt4 from hemagglutinin__InfluenzaA__ACR08549

SEQ ID NO: 155261 - RNA, 1701 nt, Artificial Sequence; identical to SEQ ID NO: 155189
  derived and/or modified sequence opt4 from hemagglutinin__InfluenzaA__ACR08550

SEQ ID NO: 155262 - RNA, 1701 nt, Artificial Sequence; identical to SEQ ID NO: 155189
  derived and/or modified sequence opt4 from hemagglutinin__InfluenzaA__ACR08551

SEQ ID NO: 155263 - RNA, 1701 nt, Artificial Sequence; identical to SEQ ID NO: 155176
  derived and/or modified sequence opt4 from hemagglutinin__InfluenzaA__ACR08552

SEQ ID NO: 155264 - RNA, 1701 nt, Artificial Sequence; identical to SEQ ID NO: 155215
  derived and/or modified sequence opt4 from hemagglutinin__InfluenzaA__ACR08553

SEQ ID NO: 155265 - RNA, 1701 nt, Artificial Sequence; identical to SEQ ID NO: 155215
  derived and/or modified sequence opt4 from hemagglutinin__InfluenzaA__ACR08554

SEQ ID NO: 155266 - RNA, 1701 nt, Artificial Sequence; identical to SEQ ID NO: 155176
  derived and/or modified sequence opt4 from hemagglutinin__InfluenzaA__ACR09365

SEQ ID NO: 155267 - RNA, 1701 nt, Artificial Sequence; identical to SEQ ID NO: 155176
  derived and/or modified sequence opt4 from hemagglutinin__InfluenzaA__ACR09366

SEQ ID NO: 155268 - RNA, 1701 nt, Artificial Sequence; identical to SEQ ID NO: 155176
  derived and/or modified sequence opt4 from hemagglutinin__InfluenzaA__ACR09367

SEQ ID NO: 155269 - RNA, 1701 nt, Artificial Sequence; identical to SEQ ID NO: 155176
  derived and/or modified sequence opt4 from hemagglutinin__InfluenzaA__ACR09368

SEQ ID NO: 155270 - RNA, 1701 nt, Artificial Sequence; identical to SEQ ID NO: 155176
  derived and/or modified sequence opt4 from hemagglutinin__InfluenzaA__ACR09369

SEQ ID NO: 155271 - RNA, 1701 nt, Artificial Sequence; identical to SEQ ID NO: 155176
  derived and/or modified sequence opt4 from hemagglutinin__InfluenzaA__ACR09370

SEQ ID NO: 155272 - RNA, 1701 nt, Artificial Sequence; identical to SEQ ID NO: 155176
  derived and/or modified sequence opt4 from hemagglutinin__InfluenzaA__ACR09371

SEQ ID NO: 155273 - RNA, 1701 nt, Artificial Sequence; identical to SEQ ID NO: 155176
  derived and/or modified sequence opt4 from hemagglutinin__InfluenzaA__ACR09373

SEQ ID NO: 155274 - RNA, 1701 nt, Artificial Sequence; identical to SEQ ID NO: 155176
  derived and/or modified sequence opt4 from hemagglutinin__InfluenzaA__ACR09374

SEQ ID NO: 155275 - RNA, 1701 nt, Artificial Sequence
  derived and/or modified sequence opt4 from hemagglutinin__InfluenzaA__ACR09375
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagaagaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155276 - RNA, 1701 nt, Artificial Sequence; identical to SEQ ID NO: 155176
  derived and/or modified sequence opt4 from hemagglutinin__InfluenzaA__ACR09376

SEQ ID NO: 155277 - RNA, 1701 nt, Artificial Sequence; identical to SEQ ID NO: 155176
  derived and/or modified sequence opt4 from hemagglutinin__InfluenzaA__ACR09377

SEQ ID NO: 155278 - RNA, 1701 nt, Artificial Sequence; identical to SEQ ID NO: 155176
  derived and/or modified sequence opt4 from hemagglutinin__InfluenzaA__ACR09395

SEQ ID NO: 155279 - RNA, 1701 nt, Artificial Sequence; identical to SEQ ID NO: 155176
  derived and/or modified sequence opt4 from hemagglutinin__InfluenzaA__ACR09396

SEQ ID NO: 155280 - RNA, 1701 nt, Artificial Sequence
  derived and/or modified sequence opt4 from hemagglutinin__InfluenzaA__ACR10186
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155281 - RNA, 1701 nt, Artificial Sequence; identical to SEQ ID NO: 155280
  derived and/or modified sequence opt4 from hemagglutinin__InfluenzaA__ACR10222

SEQ ID NO: 155282 - RNA, 1701 nt, Artificial Sequence
  derived and/or modified sequence opt4 from hemagglutinin__InfluenzaA__ACR10223
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155283 - RNA, 1701 nt, Artificial Sequence
  derived and/or modified sequence opt4 from hemagglutinin__InfluenzaA__ACR15183
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcgacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccccuacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155284 - RNA, 1698 nt, Artificial Sequence
  derived and/or modified sequence opt4 from hemagglutinin__InfluenzaA__ACR15194
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggccugggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacagaugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155285 - RNA, 1698 nt, Artificial Sequence; identical to SEQ ID NO: 153390
  derived and/or modified sequence opt4 from hemagglutinin__InfluenzaA__ACR15216

SEQ ID NO: 155286 - RNA, 1701 nt, Artificial Sequence
  derived and/or modified sequence opt4 from hemagglutinin__InfluenzaA__ACR15227
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugccagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccagaccagcggcagaaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagagacagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155287 - RNA, 1698 nt, Artificial Sequence
  derived and/or modified sequence opt4 from hemagglutinin__InfluenzaA__ACR15238
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgugcagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccagcaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155288 - RNA, 1701 nt, Artificial Sequence
  derived and/or modified sequence opt4 from hemagglutinin__InfluenzaA__ACR15249
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155289 - RNA, 1701 nt, Artificial Sequence
  derived and/or modified sequence opt4 from hemagglutinin__InfluenzaA__ACR15282
augaagaccaucaucgcccugagcuacauccugugccugguguucgcccagaagcugcccggcaacgacaacagcaccgccacccugugccugggccaccacgccgugcccaacggcaccaucgugaagaccaucaugaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155290 - RNA, 1701 nt, Artificial Sequence
  derived and/or modified sequence opt4 from hemagglutinin__InfluenzaA__ACR15293
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagaacuucaacuggaccggcgugacccagaacggcaccagcagcgccugcaagagaggcagcgacaacagcuucuucagcagacugaacuggcugacccaccugaaguucaaguaccccgcccugaaggugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155291 - RNA, 1698 nt, Artificial Sequence
  derived and/or modified sequence opt4 from hemagglutinin__InfluenzaA__ACR15304
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaccggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacagacuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155292 - RNA, 1698 nt, Artificial Sequence
  derived and/or modified sequence opt4 from hemagglutinin__InfluenzaA__ACR15315
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucagagaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155293 - RNA, 1698 nt, Artificial Sequence
  derived and/or modified sequence opt4 from hemagglutinin__InfluenzaA__ACR15326
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgagaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155294 - RNA, 1698 nt, Artificial Sequence
  derived and/or modified sequence opt4 from hemagglutinin__InfluenzaA__ACR15359
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcggccugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155295 - RNA, 1698 nt, Artificial Sequence
  derived and/or modified sequence opt4 from hemagglutinin__InfluenzaA__ACR15370
augaaggugaagcugcuggugcugcugugcacccugaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccugauccugcuggugagccugggcgccaucagcuucuggaugugcagcaacggcagccugcagugcagaaucugcaucuga

SEQ ID NO: 155296 - RNA, 1701 nt, Artificial Sequence; identical to SEQ ID NO: 154821
  derived and/or modified sequence opt4 from hemagglutinin__InfluenzaA__ACR15381

SEQ ID NO: 155297 - RNA, 1701 nt, Artificial Sequence; identical to SEQ ID NO: 154828
  derived and/or modified sequence opt4 from hemagglutinin__InfluenzaA__ACR15392

SEQ ID NO: 155298 - RNA, 1701 nt, Artificial Sequence; identical to SEQ ID NO: 154448
  derived and/or modified sequence opt4 from hemagglutinin__InfluenzaA__ACR15403

SEQ ID NO: 155299 - RNA, 1701 nt, Artificial Sequence; identical to SEQ ID NO: 154448
  derived and/or modified sequence opt4 from hemagglutinin__InfluenzaA__ACR15414

SEQ ID NO: 155300 - RNA, 1698 nt, Artificial Sequence; identical to SEQ ID NO: 155294
  derived and/or modified sequence opt4 from hemagglutinin__InfluenzaA__ACR15425

SEQ ID NO: 155301 - RNA, 1698 nt, Artificial Sequence
  derived and/or modified sequence opt4 from hemagglutinin__InfluenzaA__ACR15436
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaagggcaaggaggugcuggugcuguggggcgugcaccacccccccaacaucggcgaccagaacacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155302 - RNA, 1698 nt, Artificial Sequence
  derived and/or modified sequence opt4 from hemagglutinin__InfluenzaA__ACR15458
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaaccccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155303 - RNA, 1698 nt, Artificial Sequence
  derived and/or modified sequence opt4 from hemagglutinin__InfluenzaA__ACR15469
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccgaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaacacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155304 - RNA, 1698 nt, Artificial Sequence; identical to SEQ ID NO: 155301
  derived and/or modified sequence opt4 from hemagglutinin__InfluenzaA__ACR15480

SEQ ID NO: 155305 - RNA, 1698 nt, Artificial Sequence
  derived and/or modified sequence opt4 from hemagglutinin__InfluenzaA__ACR15491
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcagaaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcaucaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155306 - RNA, 1698 nt, Artificial Sequence
  derived and/or modified sequence opt4 from hemagglutinin__InfluenzaA__ACR15502
augaaggugaagcugcuggugcugcugugcaccuucaccgccaccuacgccgacaccaucugcaucggcuaccacgccaacaacgccaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaagggcaaggaggugcuggugcuguggggcgugcaccacccccccaacaucggcgaccagaacacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155307 - RNA, 1698 nt, Artificial Sequence; identical to SEQ ID NO: 155163
  derived and/or modified sequence opt4 from hemagglutinin__InfluenzaA__ACR15513

SEQ ID NO: 155308 - RNA, 1701 nt, Artificial Sequence
  derived and/or modified sequence opt4 from hemagglutinin__InfluenzaA__ACR15524
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugcccagcagaaucagcaucuacuggaccaucgugaagagcggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 155309 - RNA, 1701 nt, Artificial Sequence; identical to SEQ ID NO: 155117
  derived and/or modified sequence opt4 from hemagglutinin__InfluenzaA__ACR15535

SEQ ID NO: 155310 - RNA, 1701 nt, Artificial Sequence
  derived and/or modified sequence opt4 from hemagglutinin__InfluenzaA__ACR15546
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccacauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagacccagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacgagaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155311 - RNA, 1701 nt, Artificial Sequence; identical to SEQ ID NO: 154892
  derived and/or modified sequence opt4 from hemagglutinin__InfluenzaA__ACR15557

SEQ ID NO: 155312 - RNA, 1701 nt, Artificial Sequence; identical to SEQ ID NO: 153150
  derived and/or modified sequence opt4 from hemagglutinin__InfluenzaA__ACR15568

SEQ ID NO: 155313 - RNA, 1701 nt, Artificial Sequence
  derived and/or modified sequence opt4 from hemagglutinin__InfluenzaA__ACR15579
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaaccccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155314 - RNA, 1701 nt, Artificial Sequence
  derived and/or modified sequence opt4 from hemagglutinin__InfluenzaA__ACR15590
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155315 - RNA, 1701 nt, Artificial Sequence; identical to SEQ ID NO: 153150
  derived and/or modified sequence opt4 from hemagglutinin__InfluenzaA__ACR15601

SEQ ID NO: 155316 - RNA, 1701 nt, Artificial Sequence
  derived and/or modified sequence opt4 from hemagglutinin__InfluenzaA__ACR18920
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacauccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155317 - RNA, 1701 nt, Artificial Sequence; identical to SEQ ID NO: 155189
  derived and/or modified sequence opt4 from hemagglutinin__InfluenzaA__ACR18975

SEQ ID NO: 155318 - RNA, 1701 nt, Artificial Sequence; identical to SEQ ID NO: 155176
  derived and/or modified sequence opt4 from hemagglutinin__InfluenzaA__ACR18976

SEQ ID NO: 155319 - RNA, 1701 nt, Artificial Sequence; identical to SEQ ID NO: 155176
  derived and/or modified sequence opt4 from hemagglutinin__InfluenzaA__ACR18977

SEQ ID NO: 155320 - RNA, 1701 nt, Artificial Sequence; identical to SEQ ID NO: 155189
  derived and/or modified sequence opt4 from hemagglutinin__InfluenzaA__ACR18978

SEQ ID NO: 155321 - RNA, 1701 nt, Artificial Sequence; identical to SEQ ID NO: 155176
  derived and/or modified sequence opt4 from hemagglutinin__InfluenzaA__ACR18979

SEQ ID NO: 155322 - RNA, 1701 nt, Artificial Sequence; identical to SEQ ID NO: 155242
  derived and/or modified sequence opt4 from hemagglutinin__InfluenzaA__ACR18981

SEQ ID NO: 155323 - RNA, 1701 nt, Artificial Sequence; identical to SEQ ID NO: 155176
  derived and/or modified sequence opt4 from hemagglutinin__InfluenzaA__ACR18982

SEQ ID NO: 155324 - RNA, 1701 nt, Artificial Sequence; identical to SEQ ID NO: 155189
  derived and/or modified sequence opt4 from hemagglutinin__InfluenzaA__ACR18988

SEQ ID NO: 155325 - RNA, 1701 nt, Artificial Sequence
  derived and/or modified sequence opt4 from hemagglutinin__InfluenzaA__ACR18991
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacagaaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155326 - RNA, 1701 nt, Artificial Sequence; identical to SEQ ID NO: 155176
  derived and/or modified sequence opt4 from hemagglutinin__InfluenzaA__ACR18993

SEQ ID NO: 155327 - RNA, 1701 nt, Artificial Sequence; identical to SEQ ID NO: 155215
  derived and/or modified sequence opt4 from hemagglutinin__InfluenzaA__ACR18995

SEQ ID NO: 155328 - RNA, 1701 nt, Artificial Sequence; identical to SEQ ID NO: 155237
  derived and/or modified sequence opt4 from hemagglutinin__InfluenzaA__ACR23302

SEQ ID NO: 155329 - RNA, 1701 nt, Artificial Sequence; identical to SEQ ID NO: 155189
  derived and/or modified sequence opt4 from hemagglutinin__InfluenzaA__ACR33743

SEQ ID NO: 155330 - RNA, 1701 nt, Artificial Sequence; identical to SEQ ID NO: 155176
  derived and/or modified sequence opt4 from hemagglutinin__InfluenzaA__ACR38821

SEQ ID NO: 155331 - RNA, 1701 nt, Artificial Sequence; identical to SEQ ID NO: 155176
  derived and/or modified sequence opt4 from hemagglutinin__InfluenzaA__ACR38822

SEQ ID NO: 155332 - RNA, 1701 nt, Artificial Sequence; identical to SEQ ID NO: 155176
  derived and/or modified sequence opt4 from hemagglutinin__InfluenzaA__ACR38823

SEQ ID NO: 155333 - RNA, 1701 nt, Artificial Sequence; identical to SEQ ID NO: 155242
  derived and/or modified sequence opt4 from hemagglutinin__InfluenzaA__ACR38824

SEQ ID NO: 155334 - RNA, 1701 nt, Artificial Sequence
  derived and/or modified sequence opt4 from hemagglutinin__InfluenzaA__ACR38825
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155335 - RNA, 1701 nt, Artificial Sequence; identical to SEQ ID NO: 155189
  derived and/or modified sequence opt4 from hemagglutinin__InfluenzaA__ACR38826

SEQ ID NO: 155336 - RNA, 1701 nt, Artificial Sequence; identical to SEQ ID NO: 155176
  derived and/or modified sequence opt4 from hemagglutinin__InfluenzaA__ACR38827

SEQ ID NO: 155337 - RNA, 1701 nt, Artificial Sequence; identical to SEQ ID NO: 155242
  derived and/or modified sequence opt4 from hemagglutinin__InfluenzaA__ACR38828

SEQ ID NO: 155338 - RNA, 1701 nt, Artificial Sequence; identical to SEQ ID NO: 155176
  derived and/or modified sequence opt4 from hemagglutinin__InfluenzaA__ACR38829

SEQ ID NO: 155339 - RNA, 1701 nt, Artificial Sequence; identical to SEQ ID NO: 155215
  derived and/or modified sequence opt4 from hemagglutinin__InfluenzaA__ACR38830

SEQ ID NO: 155340 - RNA, 1701 nt, Artificial Sequence; identical to SEQ ID NO: 155189
  derived and/or modified sequence opt4 from hemagglutinin__InfluenzaA__ACR39354

SEQ ID NO: 155341 - RNA, 1701 nt, Artificial Sequence; identical to SEQ ID NO: 155189
  derived and/or modified sequence opt4 from hemagglutinin__InfluenzaA__ACR39393

SEQ ID NO: 155342 - RNA, 1701 nt, Artificial Sequence; identical to SEQ ID NO: 155189
  derived and/or modified sequence opt4 from hemagglutinin__InfluenzaA__ACR39403

SEQ ID NO: 155343 - RNA, 1701 nt, Artificial Sequence; identical to SEQ ID NO: 155189
  derived and/or modified sequence opt4 from hemagglutinin__InfluenzaA__ACR39413

SEQ ID NO: 155344 - RNA, 1701 nt, Artificial Sequence; identical to SEQ ID NO: 155189
  derived and/or modified sequence opt4 from hemagglutinin__InfluenzaA__ACR39423

SEQ ID NO: 155345 - RNA, 1701 nt, Artificial Sequence; identical to SEQ ID NO: 155189
  derived and/or modified sequence opt4 from hemagglutinin__InfluenzaA__ACR39433

SEQ ID NO: 155346 - RNA, 1701 nt, Artificial Sequence; identical to SEQ ID NO: 155189
  derived and/or modified sequence opt4 from hemagglutinin__InfluenzaA__ACR39443

SEQ ID NO: 155347 - RNA, 1701 nt, Artificial Sequence
  derived and/or modified sequence opt4 from hemagglutinin__InfluenzaA__ACR39453
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155348 - RNA, 1701 nt, Artificial Sequence; identical to SEQ ID NO: 155189
  derived and/or modified sequence opt4 from hemagglutinin__InfluenzaA__ACR39463

SEQ ID NO: 155349 - RNA, 1701 nt, Artificial Sequence; identical to SEQ ID NO: 155189
  derived and/or modified sequence opt4 from hemagglutinin__InfluenzaA__ACR39473

SEQ ID NO: 155350 - RNA, 1701 nt, Artificial Sequence; identical to SEQ ID NO: 155189
  derived and/or modified sequence opt4 from hemagglutinin__InfluenzaA__ACR39483

SEQ ID NO: 155351 - RNA, 1701 nt, Artificial Sequence; identical to SEQ ID NO: 155189
  derived and/or modified sequence opt4 from hemagglutinin__InfluenzaA__ACR39493

SEQ ID NO: 155352 - RNA, 1701 nt, Artificial Sequence; identical to SEQ ID NO: 155189
  derived and/or modified sequence opt4 from hemagglutinin__InfluenzaA__ACR40288

SEQ ID NO: 155353 - RNA, 1701 nt, Artificial Sequence; identical to SEQ ID NO: 155189
  derived and/or modified sequence opt4 from hemagglutinin__InfluenzaA__ACR40298

SEQ ID NO: 155354 - RNA, 1701 nt, Artificial Sequence
  derived and/or modified sequence opt4 from hemagglutinin__InfluenzaA__ACR40308
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacaucuaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155355 - RNA, 1701 nt, Artificial Sequence; identical to SEQ ID NO: 155189
  derived and/or modified sequence opt4 from hemagglutinin__InfluenzaA__ACR40318

SEQ ID NO: 155356 - RNA, 1701 nt, Artificial Sequence; identical to SEQ ID NO: 155189
  derived and/or modified sequence opt4 from hemagglutinin__InfluenzaA__ACR40328

SEQ ID NO: 155357 - RNA, 1701 nt, Artificial Sequence; identical to SEQ ID NO: 155189
  derived and/or modified sequence opt4 from hemagglutinin__InfluenzaA__ACR40338

SEQ ID NO: 155358 - RNA, 1701 nt, Artificial Sequence; identical to SEQ ID NO: 155189
  derived and/or modified sequence opt4 from hemagglutinin__InfluenzaA__ACR40348

SEQ ID NO: 155359 - RNA, 1701 nt, Artificial Sequence; identical to SEQ ID NO: 155189
  derived and/or modified sequence opt4 from hemagglutinin__InfluenzaA__ACR40358

SEQ ID NO: 155360 - RNA, 1701 nt, Artificial Sequence; identical to SEQ ID NO: 155189
  derived and/or modified sequence opt4 from hemagglutinin__InfluenzaA__ACR40378

SEQ ID NO: 155361 - RNA, 1701 nt, Artificial Sequence; identical to SEQ ID NO: 155189
  derived and/or modified sequence opt4 from hemagglutinin__InfluenzaA__ACR40388

SEQ ID NO: 155362 - RNA, 1701 nt, Artificial Sequence; identical to SEQ ID NO: 155176
  derived and/or modified sequence opt4 from hemagglutinin__InfluenzaA__ACR46986

SEQ ID NO: 155363 - RNA, 1701 nt, Artificial Sequence; identical to SEQ ID NO: 155176
  derived and/or modified sequence opt4 from hemagglutinin__InfluenzaA__ACR46988

SEQ ID NO: 155364 - RNA, 1701 nt, Artificial Sequence; identical to SEQ ID NO: 155176
  derived and/or modified sequence opt4 from hemagglutinin__InfluenzaA__ACR46989

SEQ ID NO: 155365 - RNA, 1701 nt, Artificial Sequence; identical to SEQ ID NO: 155176
  derived and/or modified sequence opt4 from hemagglutinin__InfluenzaA__ACR46990

SEQ ID NO: 155366 - RNA, 1701 nt, Artificial Sequence; identical to SEQ ID NO: 155176
  derived and/or modified sequence opt4 from hemagglutinin__InfluenzaA__ACR46992

SEQ ID NO: 155367 - RNA, 1701 nt, Artificial Sequence; identical to SEQ ID NO: 155176
  derived and/or modified sequence opt4 from hemagglutinin__InfluenzaA__ACR46993

SEQ ID NO: 155368 - RNA, 1701 nt, Artificial Sequence; identical to SEQ ID NO: 155176
  derived and/or modified sequence opt4 from hemagglutinin__InfluenzaA__ACR46994

SEQ ID NO: 155369 - RNA, 1701 nt, Artificial Sequence
  derived and/or modified sequence opt4 from hemagglutinin__InfluenzaA__ACR47006
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155370 - RNA, 1701 nt, Artificial Sequence; identical to SEQ ID NO: 155189
  derived and/or modified sequence opt4 from hemagglutinin__InfluenzaA__ACR49281

SEQ ID NO: 155371 - RNA, 1701 nt, Artificial Sequence
  derived and/or modified sequence opt4 from hemagglutinin__InfluenzaA__ACR49282
augaaggccauccugguggugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155372 - RNA, 1701 nt, Artificial Sequence; identical to SEQ ID NO: 155176
  derived and/or modified sequence opt4 from hemagglutinin__InfluenzaA__ACR49283

SEQ ID NO: 155373 - RNA, 1701 nt, Artificial Sequence; identical to SEQ ID NO: 155176
  derived and/or modified sequence opt4 from hemagglutinin__InfluenzaA__ACR49288

SEQ ID NO: 155374 - RNA, 1701 nt, Artificial Sequence; identical to SEQ ID NO: 155215
  derived and/or modified sequence opt4 from hemagglutinin__InfluenzaA__ACR49290

SEQ ID NO: 155375 - RNA, 1701 nt, Artificial Sequence; identical to SEQ ID NO: 155189
  derived and/or modified sequence opt4 from hemagglutinin__InfluenzaA__ACR49291

SEQ ID NO: 155376 - RNA, 1701 nt, Artificial Sequence; identical to SEQ ID NO: 155215
  derived and/or modified sequence opt4 from hemagglutinin__InfluenzaA__ACR49293

SEQ ID NO: 155377 - RNA, 1701 nt, Artificial Sequence; identical to SEQ ID NO: 155215
  derived and/or modified sequence opt4 from hemagglutinin__InfluenzaA__ACR49295

SEQ ID NO: 155378 - RNA, 1701 nt, Artificial Sequence; identical to SEQ ID NO: 155229
  derived and/or modified sequence opt4 from hemagglutinin__InfluenzaA__ACR50993

SEQ ID NO: 155379 - RNA, 1701 nt, Artificial Sequence; identical to SEQ ID NO: 155189
  derived and/or modified sequence opt4 from hemagglutinin__InfluenzaA__ACR50995

SEQ ID NO: 155380 - RNA, 1701 nt, Artificial Sequence; identical to SEQ ID NO: 155189
  derived and/or modified sequence opt4 from hemagglutinin__InfluenzaA__ACR51005

SEQ ID NO: 155381 - RNA, 1701 nt, Artificial Sequence; identical to SEQ ID NO: 155189
  derived and/or modified sequence opt4 from hemagglutinin__InfluenzaA__ACR51015

SEQ ID NO: 155382 - RNA, 1701 nt, Artificial Sequence; identical to SEQ ID NO: 155189
  derived and/or modified sequence opt4 from hemagglutinin__InfluenzaA__ACR51025

SEQ ID NO: 155383 - RNA, 1701 nt, Artificial Sequence; identical to SEQ ID NO: 155189
  derived and/or modified sequence opt4 from hemagglutinin__InfluenzaA__ACR51035

SEQ ID NO: 155384 - RNA, 1701 nt, Artificial Sequence; identical to SEQ ID NO: 155189
  derived and/or modified sequence opt4 from hemagglutinin__InfluenzaA__ACR51045

SEQ ID NO: 155385 - RNA, 1701 nt, Artificial Sequence; identical to SEQ ID NO: 155189
  derived and/or modified sequence opt4 from hemagglutinin__InfluenzaA__ACR51055

SEQ ID NO: 155386 - RNA, 1701 nt, Artificial Sequence; identical to SEQ ID NO: 155176
  derived and/or modified sequence opt4 from hemagglutinin__InfluenzaA__ACR51065

SEQ ID NO: 155387 - RNA, 1701 nt, Artificial Sequence; identical to SEQ ID NO: 155189
  derived and/or modified sequence opt4 from hemagglutinin__InfluenzaA__ACR52368

SEQ ID NO: 155388 - RNA, 1701 nt, Artificial Sequence; identical to SEQ ID NO: 155189
  derived and/or modified sequence opt4 from hemagglutinin__InfluenzaA__ACR52378

SEQ ID NO: 155389 - RNA, 1701 nt, Artificial Sequence; identical to SEQ ID NO: 155189
  derived and/or modified sequence opt4 from hemagglutinin__InfluenzaA__ACR52398

SEQ ID NO: 155390 - RNA, 1701 nt, Artificial Sequence; identical to SEQ ID NO: 155189
  derived and/or modified sequence opt4 from hemagglutinin__InfluenzaA__ACR52408

SEQ ID NO: 155391 - RNA, 1701 nt, Artificial Sequence; identical to SEQ ID NO: 155189
  derived and/or modified sequence opt4 from hemagglutinin__InfluenzaA__ACR52418

SEQ ID NO: 155392 - RNA, 1701 nt, Artificial Sequence; identical to SEQ ID NO: 155189
  derived and/or modified sequence opt4 from hemagglutinin__InfluenzaA__ACR52428

SEQ ID NO: 155393 - RNA, 1701 nt, Artificial Sequence; identical to SEQ ID NO: 155189
  derived and/or modified sequence opt4 from hemagglutinin__InfluenzaA__ACR52438

SEQ ID NO: 155394 - RNA, 1701 nt, Artificial Sequence; identical to SEQ ID NO: 155189
  derived and/or modified sequence opt4 from hemagglutinin__InfluenzaA__ACR52448

SEQ ID NO: 155395 - RNA, 1701 nt, Artificial Sequence; identical to SEQ ID NO: 155189
  derived and/or modified sequence opt4 from hemagglutinin__InfluenzaA__ACR52458

SEQ ID NO: 155396 - RNA, 1701 nt, Artificial Sequence; identical to SEQ ID NO: 155189
  derived and/or modified sequence opt4 from hemagglutinin__InfluenzaA__ACR52468

SEQ ID NO: 155397 - RNA, 1701 nt, Artificial Sequence; identical to SEQ ID NO: 155189
  derived and/or modified sequence opt4 from hemagglutinin__InfluenzaA__ACR52478

SEQ ID NO: 155398 - RNA, 1701 nt, Artificial Sequence; identical to SEQ ID NO: 155189
  derived and/or modified sequence opt4 from hemagglutinin__InfluenzaA__ACR52488

SEQ ID NO: 155399 - RNA, 1701 nt, Artificial Sequence; identical to SEQ ID NO: 155189
  derived and/or modified sequence opt4 from hemagglutinin__InfluenzaA__ACR54045

SEQ ID NO: 155400 - RNA, 1701 nt, Artificial Sequence
  derived and/or modified sequence opt4 from hemagglutinin__InfluenzaA__ACR54047
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcaucaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155401 - RNA, 1701 nt, Artificial Sequence
  derived and/or modified sequence opt4 from hemagglutinin__InfluenzaA__ACR54964
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaucgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155402 - RNA, 1701 nt, Artificial Sequence; identical to SEQ ID NO: 155280
  derived and/or modified sequence opt4 from hemagglutinin__InfluenzaA__ACR54974

SEQ ID NO: 155403 - RNA, 1701 nt, Artificial Sequence; identical to SEQ ID NO: 155189
  derived and/or modified sequence opt4 from hemagglutinin__InfluenzaA__ACR54984

SEQ ID NO: 155404 - RNA, 1701 nt, Artificial Sequence; identical to SEQ ID NO: 155176
  derived and/or modified sequence opt4 from hemagglutinin__InfluenzaA__ACR54994

SEQ ID NO: 155405 - RNA, 1701 nt, Artificial Sequence; identical to SEQ ID NO: 155176
  derived and/or modified sequence opt4 from hemagglutinin__InfluenzaA__ACR55004

SEQ ID NO: 155406 - RNA, 1701 nt, Artificial Sequence; identical to SEQ ID NO: 155369
  derived and/or modified sequence opt4 from hemagglutinin__InfluenzaA__ACR56380

SEQ ID NO: 155407 - RNA, 1701 nt, Artificial Sequence; identical to SEQ ID NO: 155242
  derived and/or modified sequence opt4 from hemagglutinin__InfluenzaA__ACR56390

SEQ ID NO: 155408 - RNA, 1701 nt, Artificial Sequence; identical to SEQ ID NO: 155189
  derived and/or modified sequence opt4 from hemagglutinin__InfluenzaA__ACR56400

SEQ ID NO: 155409 - RNA, 1701 nt, Artificial Sequence; identical to SEQ ID NO: 155189
  derived and/or modified sequence opt4 from hemagglutinin__InfluenzaA__ACR56410

SEQ ID NO: 155410 - RNA, 1701 nt, Artificial Sequence; identical to SEQ ID NO: 155189
  derived and/or modified sequence opt4 from hemagglutinin__InfluenzaA__ACR56420

SEQ ID NO: 155411 - RNA, 1701 nt, Artificial Sequence; identical to SEQ ID NO: 155189
  derived and/or modified sequence opt4 from hemagglutinin__InfluenzaA__ACR56430

SEQ ID NO: 155412 - RNA, 1701 nt, Artificial Sequence; identical to SEQ ID NO: 155189
  derived and/or modified sequence opt4 from hemagglutinin__InfluenzaA__ACR56440

SEQ ID NO: 155413 - RNA, 1698 nt, Artificial Sequence
  derived and/or modified sequence opt4 from hemagglutinin__InfluenzaA__ACR58541
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccagaaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgacaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155414 - RNA, 1698 nt, Artificial Sequence; identical to SEQ ID NO: 154434
  derived and/or modified sequence opt4 from hemagglutinin__InfluenzaA__ACR61655

SEQ ID NO: 155415 - RNA, 1698 nt, Artificial Sequence; identical to SEQ ID NO: 154450
  derived and/or modified sequence opt4 from hemagglutinin__InfluenzaA__ACR61666

SEQ ID NO: 155416 - RNA, 1701 nt, Artificial Sequence; identical to SEQ ID NO: 154954
  derived and/or modified sequence opt4 from hemagglutinin__InfluenzaA__ACR61677

SEQ ID NO: 155417 - RNA, 1701 nt, Artificial Sequence; identical to SEQ ID NO: 154954
  derived and/or modified sequence opt4 from hemagglutinin__InfluenzaA__ACR61688

SEQ ID NO: 155418 - RNA, 1701 nt, Artificial Sequence; identical to SEQ ID NO: 154954
  derived and/or modified sequence opt4 from hemagglutinin__InfluenzaA__ACR61699

SEQ ID NO: 155419 - RNA, 1701 nt, Artificial Sequence; identical to SEQ ID NO: 155176
  derived and/or modified sequence opt4 from hemagglutinin__InfluenzaA__ACR67170

SEQ ID NO: 155420 - RNA, 1701 nt, Artificial Sequence; identical to SEQ ID NO: 155215
  derived and/or modified sequence opt4 from hemagglutinin__InfluenzaA__ACR67171

SEQ ID NO: 155421 - RNA, 1701 nt, Artificial Sequence; identical to SEQ ID NO: 155176
  derived and/or modified sequence opt4 from hemagglutinin__InfluenzaA__ACR67172

SEQ ID NO: 155422 - RNA, 1701 nt, Artificial Sequence; identical to SEQ ID NO: 155176
  derived and/or modified sequence opt4 from hemagglutinin__InfluenzaA__ACR67177

SEQ ID NO: 155423 - RNA, 1701 nt, Artificial Sequence; identical to SEQ ID NO: 155176
  derived and/or modified sequence opt4 from hemagglutinin__InfluenzaA__ACR67181

SEQ ID NO: 155424 - RNA, 1701 nt, Artificial Sequence
  derived and/or modified sequence opt4 from hemagglutinin__InfluenzaA__ACR67183
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155425 - RNA, 1701 nt, Artificial Sequence; identical to SEQ ID NO: 155189
  derived and/or modified sequence opt4 from hemagglutinin__InfluenzaA__ACR67184

SEQ ID NO: 155426 - RNA, 1701 nt, Artificial Sequence; identical to SEQ ID NO: 155176
  derived and/or modified sequence opt4 from hemagglutinin__InfluenzaA__ACR67185

SEQ ID NO: 155427 - RNA, 1701 nt, Artificial Sequence; identical to SEQ ID NO: 155369
  derived and/or modified sequence opt4 from hemagglutinin__InfluenzaA__ACR67186

SEQ ID NO: 155428 - RNA, 1701 nt, Artificial Sequence; identical to SEQ ID NO: 155176
  derived and/or modified sequence opt4 from hemagglutinin__InfluenzaA__ACR67187

SEQ ID NO: 155429 - RNA, 1701 nt, Artificial Sequence; identical to SEQ ID NO: 155215
  derived and/or modified sequence opt4 from hemagglutinin__InfluenzaA__ACR67188

SEQ ID NO: 155430 - RNA, 1701 nt, Artificial Sequence; identical to SEQ ID NO: 155215
  derived and/or modified sequence opt4 from hemagglutinin__InfluenzaA__ACR67189

SEQ ID NO: 155431 - RNA, 1701 nt, Artificial Sequence
  derived and/or modified sequence opt4 from hemagglutinin__InfluenzaA__ACR67190
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155432 - RNA, 1701 nt, Artificial Sequence; identical to SEQ ID NO: 155176
  derived and/or modified sequence opt4 from hemagglutinin__InfluenzaA__ACR67192

SEQ ID NO: 155433 - RNA, 1701 nt, Artificial Sequence
  derived and/or modified sequence opt4 from hemagglutinin__InfluenzaA__ACR67193
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgagugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155434 - RNA, 1701 nt, Artificial Sequence; identical to SEQ ID NO: 155176
  derived and/or modified sequence opt4 from hemagglutinin__InfluenzaA__ACR67195

SEQ ID NO: 155435 - RNA, 1701 nt, Artificial Sequence; identical to SEQ ID NO: 155176
  derived and/or modified sequence opt4 from hemagglutinin__InfluenzaA__ACR67197

SEQ ID NO: 155436 - RNA, 1701 nt, Artificial Sequence; identical to SEQ ID NO: 155433
  derived and/or modified sequence opt4 from hemagglutinin__InfluenzaA__ACR67198

SEQ ID NO: 155437 - RNA, 1701 nt, Artificial Sequence; identical to SEQ ID NO: 155176
  derived and/or modified sequence opt4 from hemagglutinin__InfluenzaA__ACR67199

SEQ ID NO: 155438 - RNA, 1701 nt, Artificial Sequence; identical to SEQ ID NO: 155189
  derived and/or modified sequence opt4 from hemagglutinin__InfluenzaA__ACR67244

SEQ ID NO: 155439 - RNA, 1701 nt, Artificial Sequence
  derived and/or modified sequence opt4 from hemagglutinin__InfluenzaA__ACR67254
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgugggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155440 - RNA, 1701 nt, Artificial Sequence; identical to SEQ ID NO: 155189
  derived and/or modified sequence opt4 from hemagglutinin__InfluenzaA__ACR77438

SEQ ID NO: 155441 - RNA, 1701 nt, Artificial Sequence; identical to SEQ ID NO: 155189
  derived and/or modified sequence opt4 from hemagglutinin__InfluenzaA__ACR77448

SEQ ID NO: 155442 - RNA, 1701 nt, Artificial Sequence
  derived and/or modified sequence opt4 from hemagglutinin__InfluenzaA__ACR77458
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccuggacaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155443 - RNA, 1701 nt, Artificial Sequence; identical to SEQ ID NO: 155189
  derived and/or modified sequence opt4 from hemagglutinin__InfluenzaA__ACR77468

SEQ ID NO: 155444 - RNA, 1701 nt, Artificial Sequence; identical to SEQ ID NO: 155189
  derived and/or modified sequence opt4 from hemagglutinin__InfluenzaA__ACR77478

SEQ ID NO: 155445 - RNA, 1701 nt, Artificial Sequence; identical to SEQ ID NO: 155189
  derived and/or modified sequence opt4 from hemagglutinin__InfluenzaA__ACR77488

SEQ ID NO: 155446 - RNA, 1701 nt, Artificial Sequence; identical to SEQ ID NO: 155189
  derived and/or modified sequence opt4 from hemagglutinin__InfluenzaA__ACR77498

SEQ ID NO: 155447 - RNA, 1701 nt, Artificial Sequence; identical to SEQ ID NO: 155176
  derived and/or modified sequence opt4 from hemagglutinin__InfluenzaA__ACR83525

SEQ ID NO: 155448 - RNA, 1701 nt, Artificial Sequence
  derived and/or modified sequence opt4 from hemagglutinin__InfluenzaA__ACR83538
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccugagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155449 - RNA, 1701 nt, Artificial Sequence; identical to SEQ ID NO: 155189
  derived and/or modified sequence opt4 from hemagglutinin__InfluenzaA__ACS14666

SEQ ID NO: 155450 - RNA, 1701 nt, Artificial Sequence; identical to SEQ ID NO: 155189
  derived and/or modified sequence opt4 from hemagglutinin__InfluenzaA__ACS14676

SEQ ID NO: 155451 - RNA, 1701 nt, Artificial Sequence; identical to SEQ ID NO: 155189
  derived and/or modified sequence opt4 from hemagglutinin__InfluenzaA__ACS14686

SEQ ID NO: 155452 - RNA, 1701 nt, Artificial Sequence; identical to SEQ ID NO: 155189
  derived and/or modified sequence opt4 from hemagglutinin__InfluenzaA__ACS14696

SEQ ID NO: 155453 - RNA, 1701 nt, Artificial Sequence; identical to SEQ ID NO: 155189
  derived and/or modified sequence opt4 from hemagglutinin__InfluenzaA__ACS14706

SEQ ID NO: 155454 - RNA, 1701 nt, Artificial Sequence; identical to SEQ ID NO: 155189
  derived and/or modified sequence opt4 from hemagglutinin__InfluenzaA__ACS14716

SEQ ID NO: 155455 - RNA, 1701 nt, Artificial Sequence; identical to SEQ ID NO: 155189
  derived and/or modified sequence opt4 from hemagglutinin__InfluenzaA__ACS14726

SEQ ID NO: 155456 - RNA, 1701 nt, Artificial Sequence; identical to SEQ ID NO: 155189
  derived and/or modified sequence opt4 from hemagglutinin__InfluenzaA__ACS14736

SEQ ID NO: 155457 - RNA, 1701 nt, Artificial Sequence; identical to SEQ ID NO: 155369
  derived and/or modified sequence opt4 from hemagglutinin__InfluenzaA__ACS27189

SEQ ID NO: 155458 - RNA, 1701 nt, Artificial Sequence; identical to SEQ ID NO: 155189
  derived and/or modified sequence opt4 from hemagglutinin__InfluenzaA__ACS27199

SEQ ID NO: 155459 - RNA, 1701 nt, Artificial Sequence; identical to SEQ ID NO: 155189
  derived and/or modified sequence opt4 from hemagglutinin__InfluenzaA__ACS27209

SEQ ID NO: 155460 - RNA, 1701 nt, Artificial Sequence; identical to SEQ ID NO: 155242
  derived and/or modified sequence opt4 from hemagglutinin__InfluenzaA__ACS27219

SEQ ID NO: 155461 - RNA, 1701 nt, Artificial Sequence; identical to SEQ ID NO: 155189
  derived and/or modified sequence opt4 from hemagglutinin__InfluenzaA__ACS27229

SEQ ID NO: 155462 - RNA, 1701 nt, Artificial Sequence
  derived and/or modified sequence opt4 from hemagglutinin__InfluenzaA__ACS27239
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcaugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155463 - RNA, 1701 nt, Artificial Sequence; identical to SEQ ID NO: 155189
  derived and/or modified sequence opt4 from hemagglutinin__InfluenzaA__ACS27249

SEQ ID NO: 155464 - RNA, 1701 nt, Artificial Sequence; identical to SEQ ID NO: 155189
  derived and/or modified sequence opt4 from hemagglutinin__InfluenzaA__ACS27775

SEQ ID NO: 155465 - RNA, 1701 nt, Artificial Sequence; identical to SEQ ID NO: 155176
  derived and/or modified sequence opt4 from hemagglutinin__InfluenzaA__ACS34705

SEQ ID NO: 155466 - RNA, 1701 nt, Artificial Sequence; identical to SEQ ID NO: 155176
  derived and/or modified sequence opt4 from hemagglutinin__InfluenzaA__ACS34966

SEQ ID NO: 155467 - RNA, 1701 nt, Artificial Sequence
  derived and/or modified sequence opt4 from hemagglutinin__InfluenzaA__ACS34967
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagagcagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaaggccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155468 - RNA, 1701 nt, Artificial Sequence
  derived and/or modified sequence opt4 from hemagglutinin__InfluenzaA__ACS34968
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagagcagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaucuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155469 - RNA, 1701 nt, Artificial Sequence
  derived and/or modified sequence opt4 from hemagglutinin__InfluenzaA__ACS36632
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaaggccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155470 - RNA, 1701 nt, Artificial Sequence
  derived and/or modified sequence opt4 from hemagglutinin__InfluenzaA__ACS36645
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcaccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagagcaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcaucaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155471 - RNA, 1701 nt, Artificial Sequence
  derived and/or modified sequence opt4 from hemagglutinin__InfluenzaA__ACS45035
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagcaucuaccagaacgccgacaccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155472 - RNA, 1701 nt, Artificial Sequence; identical to SEQ ID NO: 155189
  derived and/or modified sequence opt4 from hemagglutinin__InfluenzaA__ACS50084

SEQ ID NO: 155473 - RNA, 1701 nt, Artificial Sequence; identical to SEQ ID NO: 155431
  derived and/or modified sequence opt4 from hemagglutinin__InfluenzaA__ACS50095

SEQ ID NO: 155474 - RNA, 1701 nt, Artificial Sequence
  derived and/or modified sequence opt4 from hemagglutinin__InfluenzaA__ACS54258
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacuacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155475 - RNA, 1701 nt, Artificial Sequence; identical to SEQ ID NO: 155204
  derived and/or modified sequence opt4 from hemagglutinin__InfluenzaA__ACS54259

SEQ ID NO: 155476 - RNA, 1701 nt, Artificial Sequence; identical to SEQ ID NO: 155176
  derived and/or modified sequence opt4 from hemagglutinin__InfluenzaA__ACS54260

SEQ ID NO: 155477 - RNA, 1701 nt, Artificial Sequence; identical to SEQ ID NO: 155189
  derived and/or modified sequence opt4 from hemagglutinin__InfluenzaA__ACS54261

SEQ ID NO: 155478 - RNA, 1701 nt, Artificial Sequence; identical to SEQ ID NO: 155189
  derived and/or modified sequence opt4 from hemagglutinin__InfluenzaA__ACS54263

SEQ ID NO: 155479 - RNA, 1701 nt, Artificial Sequence; identical to SEQ ID NO: 155189
  derived and/or modified sequence opt4 from hemagglutinin__InfluenzaA__ACS54301

SEQ ID NO: 155480 - RNA, 1701 nt, Artificial Sequence; identical to SEQ ID NO: 155176
  derived and/or modified sequence opt4 from hemagglutinin__InfluenzaA__ACS66821

SEQ ID NO: 155481 - RNA, 1701 nt, Artificial Sequence
  derived and/or modified sequence opt4 from hemagglutinin__InfluenzaA__ACS68822
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgagggccugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155482 - RNA, 1701 nt, Artificial Sequence; identical to SEQ ID NO: 155189
  derived and/or modified sequence opt4 from hemagglutinin__InfluenzaA__ACS75821

SEQ ID NO: 155483 - RNA, 1701 nt, Artificial Sequence; identical to SEQ ID NO: 155189
  derived and/or modified sequence opt4 from hemagglutinin__InfluenzaA__ACS77926

SEQ ID NO: 155484 - RNA, 1701 nt, Artificial Sequence; identical to SEQ ID NO: 155189
  derived and/or modified sequence opt4 from hemagglutinin__InfluenzaA__ACS77936

SEQ ID NO: 155485 - RNA, 1701 nt, Artificial Sequence; identical to SEQ ID NO: 155282
  derived and/or modified sequence opt4 from hemagglutinin__InfluenzaA__ACS77946

SEQ ID NO: 155486 - RNA, 1701 nt, Artificial Sequence; identical to SEQ ID NO: 155189
  derived and/or modified sequence opt4 from hemagglutinin__InfluenzaA__ACS77956

SEQ ID NO: 155487 - RNA, 1701 nt, Artificial Sequence; identical to SEQ ID NO: 155189
  derived and/or modified sequence opt4 from hemagglutinin__InfluenzaA__ACS77966

SEQ ID NO: 155488 - RNA, 1701 nt, Artificial Sequence; identical to SEQ ID NO: 155189
  derived and/or modified sequence opt4 from hemagglutinin__InfluenzaA__ACS77976

SEQ ID NO: 155489 - RNA, 1701 nt, Artificial Sequence; identical to SEQ ID NO: 155431
  derived and/or modified sequence opt4 from hemagglutinin__InfluenzaA__ACS77986

SEQ ID NO: 155490 - RNA, 1701 nt, Artificial Sequence
  derived and/or modified sequence opt4 from hemagglutinin__InfluenzaA__ACS77996
augaaggccacccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155491 - RNA, 1701 nt, Artificial Sequence; identical to SEQ ID NO: 155189
  derived and/or modified sequence opt4 from hemagglutinin__InfluenzaA__ACS78006

SEQ ID NO: 155492 - RNA, 1701 nt, Artificial Sequence; identical to SEQ ID NO: 155189
  derived and/or modified sequence opt4 from hemagglutinin__InfluenzaA__ACS78016

SEQ ID NO: 155493 - RNA, 1701 nt, Artificial Sequence
  derived and/or modified sequence opt4 from hemagglutinin__InfluenzaA__ACS78026
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaucagcagcuggcccaaccacgacagcaacagaggcgugaccgccgccugcccccacgccggcgccaagagcuucuacaagaaccugaucuggcuggugaagaagggcaacagcuaccccaagcugaucaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155494 - RNA, 1701 nt, Artificial Sequence; identical to SEQ ID NO: 155431
  derived and/or modified sequence opt4 from hemagglutinin__InfluenzaA__ACS78036

SEQ ID NO: 155495 - RNA, 1701 nt, Artificial Sequence; identical to SEQ ID NO: 155431
  derived and/or modified sequence opt4 from hemagglutinin__InfluenzaA__ACS78046

SEQ ID NO: 155496 - RNA, 1701 nt, Artificial Sequence; identical to SEQ ID NO: 155204
  derived and/or modified sequence opt4 from hemagglutinin__InfluenzaA__ACS92569

SEQ ID NO: 155497 - RNA, 1701 nt, Artificial Sequence; identical to SEQ ID NO: 155204
  derived and/or modified sequence opt4 from hemagglutinin__InfluenzaA__ACS92579

SEQ ID NO: 155498 - RNA, 1701 nt, Artificial Sequence; identical to SEQ ID NO: 155189
  derived and/or modified sequence opt4 from hemagglutinin__InfluenzaA__ACS92589

SEQ ID NO: 155499 - RNA, 1701 nt, Artificial Sequence
  derived and/or modified sequence opt4 from hemagglutinin__InfluenzaA__ACS92612
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccauccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcgacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155500 - RNA, 1701 nt, Artificial Sequence; identical to SEQ ID NO: 155189
  derived and/or modified sequence opt4 from hemagglutinin__InfluenzaA__ACT10307

SEQ ID NO: 155501 - RNA, 1701 nt, Artificial Sequence; identical to SEQ ID NO: 155189
  derived and/or modified sequence opt4 from hemagglutinin__InfluenzaA__ACT10314

SEQ ID NO: 155502 - RNA, 1701 nt, Artificial Sequence
  derived and/or modified sequence opt4 from hemagglutinin__InfluenzaA__ACT11057
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155503 - RNA, 1704 nt, Artificial Sequence
  derived and/or modified sequence opt4 from hemagglutinin__InfluenzaA__ACT15312
auggagaagaucgugcugcugcuggccaucgugagcaucgugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaagaacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 155504 - RNA, 1704 nt, Artificial Sequence
  derived and/or modified sequence opt4 from hemagglutinin__InfluenzaA__ACT15314
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaagaacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucaccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 155505 - RNA, 1704 nt, Artificial Sequence
  derived and/or modified sequence opt4 from hemagglutinin__InfluenzaA__ACT15316
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacugauccccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 155506 - RNA, 1704 nt, Artificial Sequence
  derived and/or modified sequence opt4 from hemagglutinin__InfluenzaA__ACT15320
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcaugagcagcgccugccccuaccagggcagaagcagcuucuucagaaacgugguguggcugaccaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 155507 - RNA, 1704 nt, Artificial Sequence
  derived and/or modified sequence opt4 from hemagglutinin__InfluenzaA__ACT15322
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagcagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 155508 - RNA, 1704 nt, Artificial Sequence
  derived and/or modified sequence opt4 from hemagglutinin__InfluenzaA__ACT15326
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacugauccccaagaucgccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 155509 - RNA, 1704 nt, Artificial Sequence
  derived and/or modified sequence opt4 from hemagglutinin__InfluenzaA__ACT15328
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagaacggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccacuacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 155510 - RNA, 1704 nt, Artificial Sequence
  derived and/or modified sequence opt4 from hemagglutinin__InfluenzaA__ACT15330
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccacuacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 155511 - RNA, 1707 nt, Artificial Sequence
  derived and/or modified sequence opt4 from hemagglutinin__InfluenzaA__ACT15332
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcgacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaaggacaacgccuaccccaccaucaagagaagcuacaacaacaccaaccaggaggaccugcuggugcuguggggcauccaccaccccaacgacgccgccgagcagaccagacuguaccacaaccccaccaccuacaucagcgugggcaccagcacccugaaccagagacuggugcccaagaucgccaccagaagcaagaucaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcagcagacuggugcuggccaccggccugagaaacagcccccagggcaagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagagagccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccuguuccuguggaugugcagcaacggcagccugcagugcagaaucugcaucuga

SEQ ID NO: 155512 - RNA, 1704 nt, Artificial Sequence
  derived and/or modified sequence opt4 from hemagglutinin__InfluenzaA__ACT15336
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 155513 - RNA, 1704 nt, Artificial Sequence
  derived and/or modified sequence opt4 from hemagglutinin__InfluenzaA__ACT15338
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaagaacaacgccuaccccaccaucaagagaagcuacaacaacaccaaccaggaggaccugcuggugcuguggggcauccaccaccccaacgacgccaccgagcagaccagacuguaccagaaccccaccaccuacaucagcgugggcaccagcacccugaaccagagacugauccccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccaggagggcagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 155514 - RNA, 1704 nt, Artificial Sequence
  derived and/or modified sequence opt4 from hemagglutinin__InfluenzaA__ACT15340
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaagaacaacgccuaccccaccaucaagagaagcuacaacaacaccaaccaggaggaccugcuggugcuguggggcauccaccaccccaacgacgccgaggagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacgcccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 155515 - RNA, 1704 nt, Artificial Sequence
  derived and/or modified sequence opt4 from hemagglutinin__InfluenzaA__ACT15342
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcagcuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacugauccuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 155516 - RNA, 1704 nt, Artificial Sequence; identical to SEQ ID NO: 155512
  derived and/or modified sequence opt4 from hemagglutinin__InfluenzaA__ACT15343

SEQ ID NO: 155517 - RNA, 1704 nt, Artificial Sequence
  derived and/or modified sequence opt4 from hemagglutinin__InfluenzaA__ACT15345
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcagcugccccuaccagggcagaagcagcuucuucagaaacgugguguggcugaccaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucggcagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 155518 - RNA, 1707 nt, Artificial Sequence
  derived and/or modified sequence opt4 from hemagglutinin__InfluenzaA__ACT15347
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcgacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaaggacaacgccuaccccaccaucaagagaagcuacaacaacaccaaccaggaggaccugcuggugcuguggggcauccaccaccccaacgacgccgccgagcagaccagacuguaccacaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcagcagacuggugcuggccaccggccugagaaacagcccccagggcaagaacagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagagagccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccuguuccuguggaugugcagcaacggcagccugcagugcagaaucugcaucuga

SEQ ID NO: 155519 - RNA, 1704 nt, Artificial Sequence
  derived and/or modified sequence opt4 from hemagglutinin__InfluenzaA__ACT15349
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaaggacaacgccuaccccaccaucaagagaagcuacaacaacaccaaccaggaggaccugcuggugcuguggggcauccaccaccccaacgacgccaccgagcagaccagacuguaccagaaccccaccaccuacaucagcgugggcaccagcacccugaaccagagacugauccccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccaggaggagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 155520 - RNA, 1707 nt, Artificial Sequence
  derived and/or modified sequence opt4 from hemagglutinin__InfluenzaA__ACT15351
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcgacuucaacgacuacgaggagcugaagcaccugcugagcagaaucaaccacuucgagaagauccagaucauccccaagagcagcuggagcgaccacgaggccagcagcggcgugagcagcgccugccccuaccagggcggcagcagcuucuucagaaacgugguguggcugaucaagaaggacaacgccuaccccaccaucaagagaagcuacaacaacaccaaccaggaggaccugcuggugcuguggggcauccaccaccccaacgacgccgccgagcagaccagacuguaccacaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcagcagacuggugcuggccaccggccugagaaacagcccccagggcaagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagagagccaucgacggcgugaccaacaaggugaacagcaucaucgacaagaugaacacccaguucgaggccgugggcagagaguucaacaagcuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccuguuccuguggaugugcagcaacggcagccugcagugcagaaucugcaucuga

SEQ ID NO: 155521 - RNA, 1704 nt, Artificial Sequence
  derived and/or modified sequence opt4 from hemagglutinin__InfluenzaA__ACT15353
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaagaacagcgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacagcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 155522 - RNA, 1707 nt, Artificial Sequence
  derived and/or modified sequence opt4 from hemagglutinin__InfluenzaA__ACT15355
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcgacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaaggacaacgccuaccccaccaucaagagaagcuacaacaacaccaaccaggaggaccugcuggugcuguggggcauccaccaccccaacgacgccgccgagcagaccagacuguaccacaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcagcagacuggugcuggccaccggccugagaaacagcccccagggcaagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagagagccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccuguuccuguggaugugcagcaacggcagccugcagugcagaaucugcaucuga

SEQ ID NO: 155523 - RNA, 1704 nt, Artificial Sequence
  derived and/or modified sequence opt4 from hemagglutinin__InfluenzaA__ACT15357
auggagaagaucgugcugcugcuggccaucgugagccuggugaagagcgaccagaucugcaucggcuaccacgccaacaacagcaccgagcagguggacaccaucauggagagaaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugacccagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacugauccccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 155524 - RNA, 1701 nt, Artificial Sequence
  derived and/or modified sequence opt4 from hemagglutinin__InfluenzaA__ACT20200
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155525 - RNA, 1701 nt, Artificial Sequence
  derived and/or modified sequence opt4 from hemagglutinin__InfluenzaA__ACT21466
augaagaccaucaucgcccugagcuacauccugugccugguguucgcccagaagcugcccggcaacgacaacagcaccgccacccccugccugggccaccacgccgugcccaacggcacccuggugaagaccaucaccaacgaccagaucgaggugaccaacgccaccgagcuggugcagagcagcagcaccggcaagaucugcgacagcccccacagaauccuggacggcaagaacugcacccugaucgacgcccugcugggcgacccccacugcgacggcuucaagaacaaggagugggaccuguucguggagagaagcaccgccuacagcaacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 155526 - RNA, 1701 nt, Artificial Sequence
  derived and/or modified sequence opt4 from hemagglutinin__InfluenzaA__ACT21467
augaagaccaucaucgcccugagcuacauccugugccugguguucgcccagaagcugcccggcagcgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacagcccccacagaauccuggacggcaagaacugcacccugaucgacgcccugcugggcgacccccacugcgacggcuucaagaacaaggagugggaccuguucguggagagaagcaccgccuacagcaacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcguguacuggaccaucgugaagcccagagacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaacagaaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 155527 - RNA, 1701 nt, Artificial Sequence
  derived and/or modified sequence opt4 from hemagglutinin__InfluenzaA__ACT21468
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacagcccccacagaauccuggacggcaagaacugcacccugaucgacgcccugcugggcgacccccacugcgacggcuucaagaacaaggagugggaccuguucguggagagaagcaccgccuacagcaacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacguggaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 155528 - RNA, 1701 nt, Artificial Sequence
  derived and/or modified sequence opt4 from hemagglutinin__InfluenzaA__ACT21469
augaagaccaucaucgcccugagcuacaucagcagacugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccaggacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 155529 - RNA, 1701 nt, Artificial Sequence
  derived and/or modified sequence opt4 from hemagglutinin__InfluenzaA__ACT21471
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccaggacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 155530 - RNA, 1701 nt, Artificial Sequence
  derived and/or modified sequence opt4 from hemagglutinin__InfluenzaA__ACT21472
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccaggacggcaccagcuacgccugcaagagaagaagcaucaagagcuucuucagcacccugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 155531 - RNA, 1701 nt, Artificial Sequence
  derived and/or modified sequence opt4 from hemagglutinin__InfluenzaA__ACT21507
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacagaacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagggcagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccagaaucgaccuguggagcuacaacgccgagcugcugguggcccuggagagccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaagagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155532 - RNA, 1701 nt, Artificial Sequence
  derived and/or modified sequence opt4 from hemagglutinin__InfluenzaA__ACT21508
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcaggacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155533 - RNA, 1701 nt, Artificial Sequence
  derived and/or modified sequence opt4 from hemagglutinin__InfluenzaA__ACT21509
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagacccagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcccaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacgagaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155534 - RNA, 1701 nt, Artificial Sequence
  derived and/or modified sequence opt4 from hemagglutinin__InfluenzaA__ACT21510
augaagaccaucaucgcccugagcuacauccugugccccguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccaggacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccgagaagcagcugagagagaacgccgaggacaugggcaacggcugcuucaagaucuaccacaagugcgacaacgccggcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155535 - RNA, 1701 nt, Artificial Sequence; identical to SEQ ID NO: 155433
  derived and/or modified sequence opt4 from hemagglutinin__InfluenzaA__ACT21572

SEQ ID NO: 155536 - RNA, 1701 nt, Artificial Sequence; identical to SEQ ID NO: 155189
  derived and/or modified sequence opt4 from hemagglutinin__InfluenzaA__ACT22031

SEQ ID NO: 155537 - RNA, 1701 nt, Artificial Sequence; identical to SEQ ID NO: 155189
  derived and/or modified sequence opt4 from hemagglutinin__InfluenzaA__ACT22032

SEQ ID NO: 155538 - RNA, 1701 nt, Artificial Sequence; identical to SEQ ID NO: 155189
  derived and/or modified sequence opt4 from hemagglutinin__InfluenzaA__ACT22033

SEQ ID NO: 155539 - RNA, 1701 nt, Artificial Sequence; identical to SEQ ID NO: 155189
  derived and/or modified sequence opt4 from hemagglutinin__InfluenzaA__ACT22034

SEQ ID NO: 155540 - RNA, 1701 nt, Artificial Sequence; identical to SEQ ID NO: 155204
  derived and/or modified sequence opt4 from hemagglutinin__InfluenzaA__ACT22035

SEQ ID NO: 155541 - RNA, 1701 nt, Artificial Sequence
  derived and/or modified sequence opt4 from hemagglutinin__InfluenzaA__ACT22036
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcugaucaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155542 - RNA, 1701 nt, Artificial Sequence
  derived and/or modified sequence opt4 from hemagglutinin__InfluenzaA__ACT22037
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155543 - RNA, 1701 nt, Artificial Sequence
  derived and/or modified sequence opt4 from hemagglutinin__InfluenzaA__ACT22038
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaacgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155544 - RNA, 1701 nt, Artificial Sequence
  derived and/or modified sequence opt4 from hemagglutinin__InfluenzaA__ACT22055
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagaaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155545 - RNA, 1701 nt, Artificial Sequence; identical to SEQ ID NO: 155502
  derived and/or modified sequence opt4 from hemagglutinin__InfluenzaA__ACT22504

SEQ ID NO: 155546 - RNA, 1701 nt, Artificial Sequence; identical to SEQ ID NO: 155431
  derived and/or modified sequence opt4 from hemagglutinin__InfluenzaA__ACT33122

SEQ ID NO: 155547 - RNA, 1701 nt, Artificial Sequence
  derived and/or modified sequence opt4 from hemagglutinin__InfluenzaA__ACT33123
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcaguucagaaucugcaucuga

SEQ ID NO: 155548 - RNA, 1701 nt, Artificial Sequence; identical to SEQ ID NO: 155189
  derived and/or modified sequence opt4 from hemagglutinin__InfluenzaA__ACT33125

SEQ ID NO: 155549 - RNA, 1701 nt, Artificial Sequence
  derived and/or modified sequence opt4 from hemagglutinin__InfluenzaA__ACT36505
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155550 - RNA, 1701 nt, Artificial Sequence
  derived and/or modified sequence opt4 from hemagglutinin__InfluenzaA__ACT36649
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagaagcuggagcuacaucguggagaccagcagcagcgacaacggcaccugcuaccccggcgacuucaucgacuacgaggagcugagagagcagcugaacagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagagccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155551 - RNA, 1701 nt, Artificial Sequence; identical to SEQ ID NO: 155189
  derived and/or modified sequence opt4 from hemagglutinin__InfluenzaA__ACT36650

SEQ ID NO: 155552 - RNA, 1701 nt, Artificial Sequence; identical to SEQ ID NO: 155189
  derived and/or modified sequence opt4 from hemagglutinin__InfluenzaA__ACT36652

SEQ ID NO: 155553 - RNA, 1701 nt, Artificial Sequence; identical to SEQ ID NO: 155187
  derived and/or modified sequence opt4 from hemagglutinin__InfluenzaA__ACT36653

SEQ ID NO: 155554 - RNA, 1701 nt, Artificial Sequence
  derived and/or modified sequence opt4 from hemagglutinin__InfluenzaA__ACT36655
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155555 - RNA, 1701 nt, Artificial Sequence; identical to SEQ ID NO: 155176
  derived and/or modified sequence opt4 from hemagglutinin__InfluenzaA__ACT36658

SEQ ID NO: 155556 - RNA, 1701 nt, Artificial Sequence; identical to SEQ ID NO: 155215
  derived and/or modified sequence opt4 from hemagglutinin__InfluenzaA__ACT36659

SEQ ID NO: 155557 - RNA, 1701 nt, Artificial Sequence; identical to SEQ ID NO: 155176
  derived and/or modified sequence opt4 from hemagglutinin__InfluenzaA__ACT36661

SEQ ID NO: 155558 - RNA, 1701 nt, Artificial Sequence; identical to SEQ ID NO: 155189
  derived and/or modified sequence opt4 from hemagglutinin__InfluenzaA__ACT36663

SEQ ID NO: 155559 - RNA, 1701 nt, Artificial Sequence; identical to SEQ ID NO: 155189
  derived and/or modified sequence opt4 from hemagglutinin__InfluenzaA__ACT36666

SEQ ID NO: 155560 - RNA, 1701 nt, Artificial Sequence
  derived and/or modified sequence opt4 from hemagglutinin__InfluenzaA__ACT52687
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagauucuaccagauccuggccaucuacagcaccguggccagcagccuggugcugguggugagccugggcgccaucagcuucuggaugugcagcaacggcagccugcagugcagaaucugcaucuga

SEQ ID NO: 155561 - RNA, 1701 nt, Artificial Sequence; identical to SEQ ID NO: 155176
  derived and/or modified sequence opt4 from hemagglutinin__InfluenzaA__ACT54606

SEQ ID NO: 155562 - RNA, 1701 nt, Artificial Sequence; identical to SEQ ID NO: 155189
  derived and/or modified sequence opt4 from hemagglutinin__InfluenzaA__ACT66146

SEQ ID NO: 155563 - RNA, 1701 nt, Artificial Sequence; identical to SEQ ID NO: 155431
  derived and/or modified sequence opt4 from hemagglutinin__InfluenzaA__ACT66155

SEQ ID NO: 155564 - RNA, 1701 nt, Artificial Sequence
  derived and/or modified sequence opt4 from hemagglutinin__InfluenzaA__ACT66162
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcaccugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155565 - RNA, 1701 nt, Artificial Sequence; identical to SEQ ID NO: 155189
  derived and/or modified sequence opt4 from hemagglutinin__InfluenzaA__ACT67239

SEQ ID NO: 155566 - RNA, 1701 nt, Artificial Sequence; identical to SEQ ID NO: 155189
  derived and/or modified sequence opt4 from hemagglutinin__InfluenzaA__ACT67255

SEQ ID NO: 155567 - RNA, 1701 nt, Artificial Sequence; identical to SEQ ID NO: 155176
  derived and/or modified sequence opt4 from hemagglutinin__InfluenzaA__ACT68102

SEQ ID NO: 155568 - RNA, 1701 nt, Artificial Sequence
  derived and/or modified sequence opt4 from hemagglutinin__InfluenzaA__ACT68103
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccugaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155569 - RNA, 1701 nt, Artificial Sequence; identical to SEQ ID NO: 155176
  derived and/or modified sequence opt4 from hemagglutinin__InfluenzaA__ACT68104

SEQ ID NO: 155570 - RNA, 1701 nt, Artificial Sequence
  derived and/or modified sequence opt4 from hemagglutinin__InfluenzaA__ACT68105
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcggcgaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155571 - RNA, 1701 nt, Artificial Sequence; identical to SEQ ID NO: 155176
  derived and/or modified sequence opt4 from hemagglutinin__InfluenzaA__ACT68106

SEQ ID NO: 155572 - RNA, 1701 nt, Artificial Sequence; identical to SEQ ID NO: 155176
  derived and/or modified sequence opt4 from hemagglutinin__InfluenzaA__ACT68107

SEQ ID NO: 155573 - RNA, 1701 nt, Artificial Sequence; identical to SEQ ID NO: 155369
  derived and/or modified sequence opt4 from hemagglutinin__InfluenzaA__ACT68108

SEQ ID NO: 155574 - RNA, 1701 nt, Artificial Sequence
  derived and/or modified sequence opt4 from hemagglutinin__InfluenzaA__ACT68109
augaaggccauccugguggugcugcuguacaccuucgccaccgccaacaccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155575 - RNA, 1701 nt, Artificial Sequence; identical to SEQ ID NO: 155176
  derived and/or modified sequence opt4 from hemagglutinin__InfluenzaA__ACT68110

SEQ ID NO: 155576 - RNA, 1701 nt, Artificial Sequence; identical to SEQ ID NO: 155176
  derived and/or modified sequence opt4 from hemagglutinin__InfluenzaA__ACT68112

SEQ ID NO: 155577 - RNA, 1701 nt, Artificial Sequence; identical to SEQ ID NO: 155176
  derived and/or modified sequence opt4 from hemagglutinin__InfluenzaA__ACT68113

SEQ ID NO: 155578 - RNA, 1701 nt, Artificial Sequence; identical to SEQ ID NO: 155176
  derived and/or modified sequence opt4 from hemagglutinin__InfluenzaA__ACT68115

SEQ ID NO: 155579 - RNA, 1701 nt, Artificial Sequence; identical to SEQ ID NO: 155176
  derived and/or modified sequence opt4 from hemagglutinin__InfluenzaA__ACT68119

SEQ ID NO: 155580 - RNA, 1701 nt, Artificial Sequence
  derived and/or modified sequence opt4 from hemagglutinin__InfluenzaA__ACT79133
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggaagcugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155581 - RNA, 1701 nt, Artificial Sequence; identical to SEQ ID NO: 155176
  derived and/or modified sequence opt4 from hemagglutinin__InfluenzaA__ACT79143

SEQ ID NO: 155582 - RNA, 1701 nt, Artificial Sequence; identical to SEQ ID NO: 155215
  derived and/or modified sequence opt4 from hemagglutinin__InfluenzaA__ACT79153

SEQ ID NO: 155583 - RNA, 1701 nt, Artificial Sequence; identical to SEQ ID NO: 155502
  derived and/or modified sequence opt4 from hemagglutinin__InfluenzaA__ACT79163

SEQ ID NO: 155584 - RNA, 1701 nt, Artificial Sequence; identical to SEQ ID NO: 155502
  derived and/or modified sequence opt4 from hemagglutinin__InfluenzaA__ACT79173

SEQ ID NO: 155585 - RNA, 1701 nt, Artificial Sequence
  derived and/or modified sequence opt4 from hemagglutinin__InfluenzaA__ACT79625
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcugaagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155586 - RNA, 1701 nt, Artificial Sequence; identical to SEQ ID NO: 155176
  derived and/or modified sequence opt4 from hemagglutinin__InfluenzaA__ACT79627

SEQ ID NO: 155587 - RNA, 1701 nt, Artificial Sequence
  derived and/or modified sequence opt4 from hemagglutinin__InfluenzaA__ACT82512
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccaguucaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155588 - RNA, 1701 nt, Artificial Sequence; identical to SEQ ID NO: 155189
  derived and/or modified sequence opt4 from hemagglutinin__InfluenzaA__ACT82513

SEQ ID NO: 155589 - RNA, 1701 nt, Artificial Sequence
  derived and/or modified sequence opt4 from hemagglutinin__InfluenzaA__ACT82514
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcaacacccccgugcacgacugcaacaccaccugccagacccccaagggcagcaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155590 - RNA, 1701 nt, Artificial Sequence; identical to SEQ ID NO: 155189
  derived and/or modified sequence opt4 from hemagglutinin__InfluenzaA__ACT82515

SEQ ID NO: 155591 - RNA, 1701 nt, Artificial Sequence
  derived and/or modified sequence opt4 from hemagglutinin__InfluenzaA__ACT82516
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugauggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155592 - RNA, 1701 nt, Artificial Sequence; identical to SEQ ID NO: 155431
  derived and/or modified sequence opt4 from hemagglutinin__InfluenzaA__ACT83795

SEQ ID NO: 155593 - RNA, 1701 nt, Artificial Sequence; identical to SEQ ID NO: 155431
  derived and/or modified sequence opt4 from hemagglutinin__InfluenzaA__ACT83805

SEQ ID NO: 155594 - RNA, 1701 nt, Artificial Sequence; identical to SEQ ID NO: 155189
  derived and/or modified sequence opt4 from hemagglutinin__InfluenzaA__ACT83815

SEQ ID NO: 155595 - RNA, 1701 nt, Artificial Sequence; identical to SEQ ID NO: 155189
  derived and/or modified sequence opt4 from hemagglutinin__InfluenzaA__ACT83825

SEQ ID NO: 155596 - RNA, 1701 nt, Artificial Sequence; identical to SEQ ID NO: 155189
  derived and/or modified sequence opt4 from hemagglutinin__InfluenzaA__ACT83835

SEQ ID NO: 155597 - RNA, 1701 nt, Artificial Sequence; identical to SEQ ID NO: 155282
  derived and/or modified sequence opt4 from hemagglutinin__InfluenzaA__ACT83845

SEQ ID NO: 155598 - RNA, 1701 nt, Artificial Sequence; identical to SEQ ID NO: 155176
  derived and/or modified sequence opt4 from hemagglutinin__InfluenzaA__ACT83855

SEQ ID NO: 155599 - RNA, 1701 nt, Artificial Sequence; identical to SEQ ID NO: 155189
  derived and/or modified sequence opt4 from hemagglutinin__InfluenzaA__ACT83865

SEQ ID NO: 155600 - RNA, 1701 nt, Artificial Sequence; identical to SEQ ID NO: 155431
  derived and/or modified sequence opt4 from hemagglutinin__InfluenzaA__ACT83875

SEQ ID NO: 155601 - RNA, 1701 nt, Artificial Sequence; identical to SEQ ID NO: 155431
  derived and/or modified sequence opt4 from hemagglutinin__InfluenzaA__ACT85999

SEQ ID NO: 155602 - RNA, 1701 nt, Artificial Sequence; identical to SEQ ID NO: 155431
  derived and/or modified sequence opt4 from hemagglutinin__InfluenzaA__ACT86009

SEQ ID NO: 155603 - RNA, 1701 nt, Artificial Sequence; identical to SEQ ID NO: 155189
  derived and/or modified sequence opt4 from hemagglutinin__InfluenzaA__ACT86019

SEQ ID NO: 155604 - RNA, 1701 nt, Artificial Sequence; identical to SEQ ID NO: 155282
  derived and/or modified sequence opt4 from hemagglutinin__InfluenzaA__ACT86029

SEQ ID NO: 155605 - RNA, 1701 nt, Artificial Sequence; identical to SEQ ID NO: 155189
  derived and/or modified sequence opt4 from hemagglutinin__InfluenzaA__ACT86039

SEQ ID NO: 155606 - RNA, 1701 nt, Artificial Sequence; identical to SEQ ID NO: 155189
  derived and/or modified sequence opt4 from hemagglutinin__InfluenzaA__ACT86059

SEQ ID NO: 155607 - RNA, 1701 nt, Artificial Sequence; identical to SEQ ID NO: 155189
  derived and/or modified sequence opt4 from hemagglutinin__InfluenzaA__ACT86069

SEQ ID NO: 155608 - RNA, 1701 nt, Artificial Sequence; identical to SEQ ID NO: 155189
  derived and/or modified sequence opt4 from hemagglutinin__InfluenzaA__ACT86079

SEQ ID NO: 155609 - RNA, 1701 nt, Artificial Sequence; identical to SEQ ID NO: 155189
  derived and/or modified sequence opt4 from hemagglutinin__InfluenzaA__ACT86089

SEQ ID NO: 155610 - RNA, 1701 nt, Artificial Sequence; identical to SEQ ID NO: 155189
  derived and/or modified sequence opt4 from hemagglutinin__InfluenzaA__ACT86099

SEQ ID NO: 155611 - RNA, 1701 nt, Artificial Sequence; identical to SEQ ID NO: 155431
  derived and/or modified sequence opt4 from hemagglutinin__InfluenzaA__ACT86109

SEQ ID NO: 155612 - RNA, 1701 nt, Artificial Sequence; identical to SEQ ID NO: 155189
  derived and/or modified sequence opt4 from hemagglutinin__InfluenzaA__ACT86119

SEQ ID NO: 155613 - RNA, 1701 nt, Artificial Sequence; identical to SEQ ID NO: 155431
  derived and/or modified sequence opt4 from hemagglutinin__InfluenzaA__ACT86129

SEQ ID NO: 155614 - RNA, 1701 nt, Artificial Sequence; identical to SEQ ID NO: 155189
  derived and/or modified sequence opt4 from hemagglutinin__InfluenzaA__ACT86139

SEQ ID NO: 155615 - RNA, 1701 nt, Artificial Sequence
  derived and/or modified sequence opt4 from hemagglutinin__InfluenzaA__ACU00932
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaacuucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155616 - RNA, 1701 nt, Artificial Sequence; identical to SEQ ID NO: 155189
  derived and/or modified sequence opt4 from hemagglutinin__InfluenzaA__ACU00942

SEQ ID NO: 155617 - RNA, 1701 nt, Artificial Sequence; identical to SEQ ID NO: 155189
  derived and/or modified sequence opt4 from hemagglutinin__InfluenzaA__ACU00952

SEQ ID NO: 155618 - RNA, 1701 nt, Artificial Sequence
  derived and/or modified sequence opt4 from hemagglutinin__InfluenzaA__ACU12494
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcgagagcuacgccugcaagagaggcagcgugaagagcuucuucagcagacugaacuggcugcacgagagcgacuacaaguaccccgcccugaacgugaccaugcccaacaacggcaaguucgacaagcuguacaucuggggcgugcaccaccccaucaccgacagagagcagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 155619 - RNA, 1698 nt, Artificial Sequence; identical to SEQ ID NO: 155301
  derived and/or modified sequence opt4 from hemagglutinin__InfluenzaA__ACU12505

SEQ ID NO: 155620 - RNA, 1701 nt, Artificial Sequence
  derived and/or modified sequence opt4 from hemagglutinin__InfluenzaA__ACU12516
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugguggacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagacccagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155621 - RNA, 1701 nt, Artificial Sequence; identical to SEQ ID NO: 153150
  derived and/or modified sequence opt4 from hemagglutinin__InfluenzaA__ACU12527

SEQ ID NO: 155622 - RNA, 1701 nt, Artificial Sequence; identical to SEQ ID NO: 154892
  derived and/or modified sequence opt4 from hemagglutinin__InfluenzaA__ACU12538

SEQ ID NO: 155623 - RNA, 1701 nt, Artificial Sequence; identical to SEQ ID NO: 154088
  derived and/or modified sequence opt4 from hemagglutinin__InfluenzaA__ACU12549

SEQ ID NO: 155624 - RNA, 1698 nt, Artificial Sequence
  derived and/or modified sequence opt4 from hemagglutinin__InfluenzaA__ACU12560
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaagggcaaggaggugcuggugcuguggggcgugcaccacccccccaacaucggcgaccagaacacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgugcccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155625 - RNA, 1698 nt, Artificial Sequence; identical to SEQ ID NO: 155008
  derived and/or modified sequence opt4 from hemagglutinin__InfluenzaA__ACU12571

SEQ ID NO: 155626 - RNA, 1698 nt, Artificial Sequence
  derived and/or modified sequence opt4 from hemagglutinin__InfluenzaA__ACU12582
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggcagauucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaagggcaaggaggugcuggugcuguggggcgugcaccacccccccaacaucggcgaccagaacacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155627 - RNA, 1698 nt, Artificial Sequence
  derived and/or modified sequence opt4 from hemagglutinin__InfluenzaA__ACU12593
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcaucaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155628 - RNA, 1701 nt, Artificial Sequence; identical to SEQ ID NO: 155189
  derived and/or modified sequence opt4 from hemagglutinin__InfluenzaA__ACU13090

SEQ ID NO: 155629 - RNA, 1701 nt, Artificial Sequence; identical to SEQ ID NO: 155189
  derived and/or modified sequence opt4 from hemagglutinin__InfluenzaA__ACU13091

SEQ ID NO: 155630 - RNA, 1701 nt, Artificial Sequence; identical to SEQ ID NO: 155189
  derived and/or modified sequence opt4 from hemagglutinin__InfluenzaA__ACU13092

SEQ ID NO: 155631 - RNA, 1701 nt, Artificial Sequence; identical to SEQ ID NO: 155189
  derived and/or modified sequence opt4 from hemagglutinin__InfluenzaA__ACU13093

SEQ ID NO: 155632 - RNA, 1701 nt, Artificial Sequence
  derived and/or modified sequence opt4 from hemagglutinin__InfluenzaA__ACU13094
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155633 - RNA, 1701 nt, Artificial Sequence; identical to SEQ ID NO: 155189
  derived and/or modified sequence opt4 from hemagglutinin__InfluenzaA__ACU13095

SEQ ID NO: 155634 - RNA, 1701 nt, Artificial Sequence
  derived and/or modified sequence opt4 from hemagglutinin__InfluenzaA__ACU13096
augaaggccauccugguggugcugcugcacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugacccuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155635 - RNA, 1701 nt, Artificial Sequence; identical to SEQ ID NO: 155189
  derived and/or modified sequence opt4 from hemagglutinin__InfluenzaA__ACU13098

SEQ ID NO: 155636 - RNA, 1701 nt, Artificial Sequence
  derived and/or modified sequence opt4 from hemagglutinin__InfluenzaA__ACU13099
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155637 - RNA, 1701 nt, Artificial Sequence
  derived and/or modified sequence opt4 from hemagglutinin__InfluenzaA__ACU13129
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcgaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155638 - RNA, 1701 nt, Artificial Sequence; identical to SEQ ID NO: 155189
  derived and/or modified sequence opt4 from hemagglutinin__InfluenzaA__ACU16795

SEQ ID NO: 155639 - RNA, 1701 nt, Artificial Sequence; identical to SEQ ID NO: 155189
  derived and/or modified sequence opt4 from hemagglutinin__InfluenzaA__ACU16858

SEQ ID NO: 155640 - RNA, 1701 nt, Artificial Sequence; identical to SEQ ID NO: 155189
  derived and/or modified sequence opt4 from hemagglutinin__InfluenzaA__ACU16930

SEQ ID NO: 155641 - RNA, 1701 nt, Artificial Sequence; identical to SEQ ID NO: 155189
  derived and/or modified sequence opt4 from hemagglutinin__InfluenzaA__ACU16993

SEQ ID NO: 155642 - RNA, 1701 nt, Artificial Sequence; identical to SEQ ID NO: 155189
  derived and/or modified sequence opt4 from hemagglutinin__InfluenzaA__ACU17059

SEQ ID NO: 155643 - RNA, 1701 nt, Artificial Sequence; identical to SEQ ID NO: 155189
  derived and/or modified sequence opt4 from hemagglutinin__InfluenzaA__ACU17126

SEQ ID NO: 155644 - RNA, 1701 nt, Artificial Sequence; identical to SEQ ID NO: 155280
  derived and/or modified sequence opt4 from hemagglutinin__InfluenzaA__ACU17187

SEQ ID NO: 155645 - RNA, 1701 nt, Artificial Sequence; identical to SEQ ID NO: 155189
  derived and/or modified sequence opt4 from hemagglutinin__InfluenzaA__ACU17258

SEQ ID NO: 155646 - RNA, 1701 nt, Artificial Sequence
  derived and/or modified sequence opt4 from hemagglutinin__InfluenzaA__ACU17389
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccgccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155647 - RNA, 1701 nt, Artificial Sequence; identical to SEQ ID NO: 155189
  derived and/or modified sequence opt4 from hemagglutinin__InfluenzaA__ACU17450

SEQ ID NO: 155648 - RNA, 1701 nt, Artificial Sequence; identical to SEQ ID NO: 155189
  derived and/or modified sequence opt4 from hemagglutinin__InfluenzaA__ACU17521

SEQ ID NO: 155649 - RNA, 1701 nt, Artificial Sequence; identical to SEQ ID NO: 155176
  derived and/or modified sequence opt4 from hemagglutinin__InfluenzaA__ACU27041

SEQ ID NO: 155650 - RNA, 1698 nt, Artificial Sequence
  derived and/or modified sequence opt4 from hemagglutinin__InfluenzaA__ACU27406
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaagaucagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagagaaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155651 - RNA, 1698 nt, Artificial Sequence
  derived and/or modified sequence opt4 from hemagglutinin__InfluenzaA__ACU27407
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155652 - RNA, 1701 nt, Artificial Sequence; identical to SEQ ID NO: 155176
  derived and/or modified sequence opt4 from hemagglutinin__InfluenzaA__ACU29949

SEQ ID NO: 155653 - RNA, 1701 nt, Artificial Sequence
  derived and/or modified sequence opt4 from hemagglutinin__InfluenzaA__ACU29979
augaaggccauccugguggugcugcuguacaccuucgccgccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155654 - RNA, 1701 nt, Artificial Sequence; identical to SEQ ID NO: 155189
  derived and/or modified sequence opt4 from hemagglutinin__InfluenzaA__ACU29989

SEQ ID NO: 155655 - RNA, 1704 nt, Artificial Sequence
  derived and/or modified sequence opt4 from hemagglutinin__InfluenzaA__ACU29999
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcugcagugcagaaucugcaucuga

SEQ ID NO: 155656 - RNA, 1704 nt, Artificial Sequence
  derived and/or modified sequence opt4 from hemagglutinin__InfluenzaA__ACU30009
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggcuacggcagccugcagugcagaaucugcaucuga

SEQ ID NO: 155657 - RNA, 1701 nt, Artificial Sequence; identical to SEQ ID NO: 155549
  derived and/or modified sequence opt4 from hemagglutinin__InfluenzaA__ACU30019

SEQ ID NO: 155658 - RNA, 1701 nt, Artificial Sequence; identical to SEQ ID NO: 155369
  derived and/or modified sequence opt4 from hemagglutinin__InfluenzaA__ACU30093

SEQ ID NO: 155659 - RNA, 1701 nt, Artificial Sequence
  derived and/or modified sequence opt4 from hemagglutinin__InfluenzaA__ACU30103
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuaccacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155660 - RNA, 1704 nt, Artificial Sequence
  derived and/or modified sequence opt4 from hemagglutinin__InfluenzaA__ACU30112
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagccacauggugcugcugcagugcagaaucugcaucuga

SEQ ID NO: 155661 - RNA, 1701 nt, Artificial Sequence
  derived and/or modified sequence opt4 from hemagglutinin__InfluenzaA__ACU30121
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155662 - RNA, 1701 nt, Artificial Sequence; identical to SEQ ID NO: 155282
  derived and/or modified sequence opt4 from hemagglutinin__InfluenzaA__ACU31124

SEQ ID NO: 155663 - RNA, 1701 nt, Artificial Sequence; identical to SEQ ID NO: 155221
  derived and/or modified sequence opt4 from hemagglutinin__InfluenzaA__ACU31143

SEQ ID NO: 155664 - RNA, 1701 nt, Artificial Sequence; identical to SEQ ID NO: 155221
  derived and/or modified sequence opt4 from hemagglutinin__InfluenzaA__ACU31144

SEQ ID NO: 155665 - RNA, 1701 nt, Artificial Sequence; identical to SEQ ID NO: 155221
  derived and/or modified sequence opt4 from hemagglutinin__InfluenzaA__ACU31145

SEQ ID NO: 155666 - RNA, 1701 nt, Artificial Sequence; identical to SEQ ID NO: 155369
  derived and/or modified sequence opt4 from hemagglutinin__InfluenzaA__ACU31146

SEQ ID NO: 155667 - RNA, 1701 nt, Artificial Sequence; identical to SEQ ID NO: 155189
  derived and/or modified sequence opt4 from hemagglutinin__InfluenzaA__ACU31147

SEQ ID NO: 155668 - RNA, 1701 nt, Artificial Sequence
  derived and/or modified sequence opt4 from hemagglutinin__InfluenzaA__ACU31148
augaaggccauccuggugaucaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155669 - RNA, 1701 nt, Artificial Sequence; identical to SEQ ID NO: 155176
  derived and/or modified sequence opt4 from hemagglutinin__InfluenzaA__ACU31149

SEQ ID NO: 155670 - RNA, 1701 nt, Artificial Sequence; identical to SEQ ID NO: 155176
  derived and/or modified sequence opt4 from hemagglutinin__InfluenzaA__ACU31150

SEQ ID NO: 155671 - RNA, 1701 nt, Artificial Sequence; identical to SEQ ID NO: 155176
  derived and/or modified sequence opt4 from hemagglutinin__InfluenzaA__ACU31151

SEQ ID NO: 155672 - RNA, 1701 nt, Artificial Sequence; identical to SEQ ID NO: 155176
  derived and/or modified sequence opt4 from hemagglutinin__InfluenzaA__ACU31152

SEQ ID NO: 155673 - RNA, 1707 nt, Artificial Sequence
  derived and/or modified sequence opt4 from hemagglutinin__InfluenzaA__ACU46644
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcggcaagccccugauccugagagacugcagaguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcugugguggauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccaccacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaaccaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacgacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 155674 - RNA, 1701 nt, Artificial Sequence
  derived and/or modified sequence opt4 from hemagglutinin__InfluenzaA__ACU56924
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155675 - RNA, 1701 nt, Artificial Sequence; identical to SEQ ID NO: 155542
  derived and/or modified sequence opt4 from hemagglutinin__InfluenzaA__ACU56931

SEQ ID NO: 155676 - RNA, 1701 nt, Artificial Sequence; identical to SEQ ID NO: 155189
  derived and/or modified sequence opt4 from hemagglutinin__InfluenzaA__ACU64792

SEQ ID NO: 155677 - RNA, 1701 nt, Artificial Sequence; identical to SEQ ID NO: 155369
  derived and/or modified sequence opt4 from hemagglutinin__InfluenzaA__ACU64801

SEQ ID NO: 155678 - RNA, 1701 nt, Artificial Sequence; identical to SEQ ID NO: 155369
  derived and/or modified sequence opt4 from hemagglutinin__InfluenzaA__ACU64812

SEQ ID NO: 155679 - RNA, 1701 nt, Artificial Sequence; identical to SEQ ID NO: 154838
  derived and/or modified sequence opt4 from hemagglutinin__InfluenzaA__ACU79871

SEQ ID NO: 155680 - RNA, 1701 nt, Artificial Sequence; identical to SEQ ID NO: 154836
  derived and/or modified sequence opt4 from hemagglutinin__InfluenzaA__ACU79882

SEQ ID NO: 155681 - RNA, 1701 nt, Artificial Sequence; identical to SEQ ID NO: 154849
  derived and/or modified sequence opt4 from hemagglutinin__InfluenzaA__ACU79893

SEQ ID NO: 155682 - RNA, 1701 nt, Artificial Sequence; identical to SEQ ID NO: 154849
  derived and/or modified sequence opt4 from hemagglutinin__InfluenzaA__ACU79904

SEQ ID NO: 155683 - RNA, 1698 nt, Artificial Sequence
  derived and/or modified sequence opt4 from hemagglutinin__InfluenzaA__ACU79937
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugaccgccagcugcagccacaacggcaagagcagcuucuacagaaaccugcuguggcugaccgagaagaacggccuguaccccaaccugagcaacagcuacgugaacaacaaggagaaggaggugcuggugcuguggggcgugcaccaccccagcaacaucggcgugcagagagccaucuaccacaccgagaacgccuacgugagcguggugagcagccacuacagcagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugaacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugauggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155684 - RNA, 1689 nt, Artificial Sequence
  derived and/or modified sequence opt4 from hemagglutinin__InfluenzaA__ACU79948
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaagaagggcagcgacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgagaucgccaccagacccaaggugaacggccagggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaacgugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 155685 - RNA, 1689 nt, Artificial Sequence
  derived and/or modified sequence opt4 from hemagglutinin__InfluenzaA__ACU79959
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaagaagggcagcgacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgagaucgccaccagacccaaggugaacggccagggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 155686 - RNA, 1701 nt, Artificial Sequence
  derived and/or modified sequence opt4 from hemagglutinin__InfluenzaA__ACU79970
augaagaccaucaucgcccugagcuacauccagugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaacugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcaagcugaacuggcugacccacagcaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 155687 - RNA, 1698 nt, Artificial Sequence
  derived and/or modified sequence opt4 from hemagglutinin__InfluenzaA__ACU79981
augaaggugaagcugcuggugcugcugugcaccuucaccgccaccuacgccgacaccaucugcaucggcuaccacgccaacaacagcaccgacaccguggacaccgugcuggagagaaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcugaagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155688 - RNA, 1698 nt, Artificial Sequence
  derived and/or modified sequence opt4 from hemagglutinin__InfluenzaA__ACU79992
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaaggccccccugcagcugggcaacugcagcguggccggcuggauccugggcaaccccgagugcggccugcugaucagcaaggagagcuggagcuacaucguggagagacccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaugacccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155689 - RNA, 1701 nt, Artificial Sequence; identical to SEQ ID NO: 154954
  derived and/or modified sequence opt4 from hemagglutinin__InfluenzaA__ACU80003

SEQ ID NO: 155690 - RNA, 1698 nt, Artificial Sequence
  derived and/or modified sequence opt4 from hemagglutinin__InfluenzaA__ACU80025
augaaggugaagcugcuggugcugcugugcaccuucgccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155691 - RNA, 1701 nt, Artificial Sequence
  derived and/or modified sequence opt4 from hemagglutinin__InfluenzaA__ACU80036
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaucggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155692 - RNA, 1698 nt, Artificial Sequence; identical to SEQ ID NO: 155163
  derived and/or modified sequence opt4 from hemagglutinin__InfluenzaA__ACU80047

SEQ ID NO: 155693 - RNA, 1701 nt, Artificial Sequence
  derived and/or modified sequence opt4 from hemagglutinin__InfluenzaA__ACU80058
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccugcagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155694 - RNA, 1698 nt, Artificial Sequence; identical to SEQ ID NO: 155008
  derived and/or modified sequence opt4 from hemagglutinin__InfluenzaA__ACU80069

SEQ ID NO: 155695 - RNA, 1698 nt, Artificial Sequence
  derived and/or modified sequence opt4 from hemagglutinin__InfluenzaA__ACU80080
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcaucaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155696 - RNA, 1698 nt, Artificial Sequence; identical to SEQ ID NO: 155294
  derived and/or modified sequence opt4 from hemagglutinin__InfluenzaA__ACU80091

SEQ ID NO: 155697 - RNA, 1701 nt, Artificial Sequence; identical to SEQ ID NO: 155057
  derived and/or modified sequence opt4 from hemagglutinin__InfluenzaA__ACU80102

SEQ ID NO: 155698 - RNA, 1701 nt, Artificial Sequence
  derived and/or modified sequence opt4 from hemagglutinin__InfluenzaA__ACU80113
augaagaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaacugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagaucgagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaagaacuggauccuguggaucagcuucgccaucagcugcuuccugcugugcaucgcccugcugggcuucaucaugugggccugccagaagggcaacaucagaugcaacaucugcaucuga

SEQ ID NO: 155699 - RNA, 1701 nt, Artificial Sequence
  derived and/or modified sequence opt4 from hemagglutinin__InfluenzaA__ACU80135
augaagaccaucaucgcccugagcuacauccugugccugguguucgcccagaaguuccccggcaacgacaacagcaccgccacccugugccugggccaccacgccgugcccaacggcaccauggugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaacugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 155700 - RNA, 1701 nt, Artificial Sequence
  derived and/or modified sequence opt4 from hemagglutinin__InfluenzaA__ACU80146
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggccugaucaugugggccugccagaagggcaacaucagaugcaacaucugcaucuga

SEQ ID NO: 155701 - RNA, 1701 nt, Artificial Sequence; identical to SEQ ID NO: 154954
  derived and/or modified sequence opt4 from hemagglutinin__InfluenzaA__ACU80157

SEQ ID NO: 155702 - RNA, 1698 nt, Artificial Sequence; identical to SEQ ID NO: 155690
  derived and/or modified sequence opt4 from hemagglutinin__InfluenzaA__ACU80168

SEQ ID NO: 155703 - RNA, 1701 nt, Artificial Sequence; identical to SEQ ID NO: 154954
  derived and/or modified sequence opt4 from hemagglutinin__InfluenzaA__ACU80179

SEQ ID NO: 155704 - RNA, 1701 nt, Artificial Sequence
  derived and/or modified sequence opt4 from hemagglutinin__InfluenzaA__ACU80190
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcaucgagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155705 - RNA, 1701 nt, Artificial Sequence
  derived and/or modified sequence opt4 from hemagglutinin__InfluenzaA__ACU80201
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucaagugcaacaucugcaucuga

SEQ ID NO: 155706 - RNA, 1701 nt, Artificial Sequence; identical to SEQ ID NO: 154954
  derived and/or modified sequence opt4 from hemagglutinin__InfluenzaA__ACU80212

SEQ ID NO: 155707 - RNA, 1698 nt, Artificial Sequence
  derived and/or modified sequence opt4 from hemagglutinin__InfluenzaA__ACU80234
augaaggugaagcugcuggugcugcugugcaccuucgccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155708 - RNA, 1701 nt, Artificial Sequence
  derived and/or modified sequence opt4 from hemagglutinin__InfluenzaA__ACU80245
augaagaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaacugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcagaugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 155709 - RNA, 1701 nt, Artificial Sequence; identical to SEQ ID NO: 155057
  derived and/or modified sequence opt4 from hemagglutinin__InfluenzaA__ACU80256

SEQ ID NO: 155710 - RNA, 1698 nt, Artificial Sequence; identical to SEQ ID NO: 155008
  derived and/or modified sequence opt4 from hemagglutinin__InfluenzaA__ACU80267

SEQ ID NO: 155711 - RNA, 1698 nt, Artificial Sequence; identical to SEQ ID NO: 155690
  derived and/or modified sequence opt4 from hemagglutinin__InfluenzaA__ACU80278

SEQ ID NO: 155712 - RNA, 1701 nt, Artificial Sequence; identical to SEQ ID NO: 154954
  derived and/or modified sequence opt4 from hemagglutinin__InfluenzaA__ACU80289

SEQ ID NO: 155713 - RNA, 1701 nt, Artificial Sequence; identical to SEQ ID NO: 155057
  derived and/or modified sequence opt4 from hemagglutinin__InfluenzaA__ACU80300

SEQ ID NO: 155714 - RNA, 1701 nt, Artificial Sequence
  derived and/or modified sequence opt4 from hemagglutinin__InfluenzaA__ACU80311
augagaaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaacugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 155715 - RNA, 1701 nt, Artificial Sequence; identical to SEQ ID NO: 155057
  derived and/or modified sequence opt4 from hemagglutinin__InfluenzaA__ACU80322

SEQ ID NO: 155716 - RNA, 1701 nt, Artificial Sequence; identical to SEQ ID NO: 154954
  derived and/or modified sequence opt4 from hemagglutinin__InfluenzaA__ACU80333

SEQ ID NO: 155717 - RNA, 1701 nt, Artificial Sequence; identical to SEQ ID NO: 155057
  derived and/or modified sequence opt4 from hemagglutinin__InfluenzaA__ACU80344

SEQ ID NO: 155718 - RNA, 1701 nt, Artificial Sequence; identical to SEQ ID NO: 155057
  derived and/or modified sequence opt4 from hemagglutinin__InfluenzaA__ACU80355

SEQ ID NO: 155719 - RNA, 1701 nt, Artificial Sequence; identical to SEQ ID NO: 155057
  derived and/or modified sequence opt4 from hemagglutinin__InfluenzaA__ACU80366

SEQ ID NO: 155720 - RNA, 1701 nt, Artificial Sequence
  derived and/or modified sequence opt4 from hemagglutinin__InfluenzaA__ACU80377
augaagaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaacugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacuucgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccugcugugcaucgcccugcugggcuucaucaugugggccugccagaagggcaacaucagaugcaacaucugcaucuga

SEQ ID NO: 155721 - RNA, 1701 nt, Artificial Sequence; identical to SEQ ID NO: 155057
  derived and/or modified sequence opt4 from hemagglutinin__InfluenzaA__ACU80388

SEQ ID NO: 155722 - RNA, 1701 nt, Artificial Sequence; identical to SEQ ID NO: 154954
  derived and/or modified sequence opt4 from hemagglutinin__InfluenzaA__ACU80399

SEQ ID NO: 155723 - RNA, 1698 nt, Artificial Sequence
  derived and/or modified sequence opt4 from hemagglutinin__InfluenzaA__ACU80410
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155724 - RNA, 1701 nt, Artificial Sequence
  derived and/or modified sequence opt4 from hemagglutinin__InfluenzaA__ACU80424
augaagaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaacugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgagaacuucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacuucgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 155725 - RNA, 1701 nt, Artificial Sequence; identical to SEQ ID NO: 155724
  derived and/or modified sequence opt4 from hemagglutinin__InfluenzaA__ACU80435

SEQ ID NO: 155726 - RNA, 1698 nt, Artificial Sequence
  derived and/or modified sequence opt4 from hemagglutinin__InfluenzaA__ACU80446
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcauggagguguaccagauccuggccaucuacagcaccguggccagcagccuggugcugcuggugagccugggcgccaucagcuucuggaugugcagcaacggcagccugcagugcagaaucugcaucuga

SEQ ID NO: 155727 - RNA, 1701 nt, Artificial Sequence; identical to SEQ ID NO: 154954
  derived and/or modified sequence opt4 from hemagglutinin__InfluenzaA__ACU80458

SEQ ID NO: 155728 - RNA, 1701 nt, Artificial Sequence; identical to SEQ ID NO: 154954
  derived and/or modified sequence opt4 from hemagglutinin__InfluenzaA__ACU80470

SEQ ID NO: 155729 - RNA, 1701 nt, Artificial Sequence; identical to SEQ ID NO: 155057
  derived and/or modified sequence opt4 from hemagglutinin__InfluenzaA__ACU80600

SEQ ID NO: 155730 - RNA, 1701 nt, Artificial Sequence; identical to SEQ ID NO: 155724
  derived and/or modified sequence opt4 from hemagglutinin__InfluenzaA__ACU80611

SEQ ID NO: 155731 - RNA, 1701 nt, Artificial Sequence; identical to SEQ ID NO: 155057
  derived and/or modified sequence opt4 from hemagglutinin__InfluenzaA__ACU80622

SEQ ID NO: 155732 - RNA, 1701 nt, Artificial Sequence; identical to SEQ ID NO: 154954
  derived and/or modified sequence opt4 from hemagglutinin__InfluenzaA__ACU80633

SEQ ID NO: 155733 - RNA, 1701 nt, Artificial Sequence
  derived and/or modified sequence opt4 from hemagglutinin__InfluenzaA__ACU80644
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155734 - RNA, 1701 nt, Artificial Sequence; identical to SEQ ID NO: 154954
  derived and/or modified sequence opt4 from hemagglutinin__InfluenzaA__ACU80655

SEQ ID NO: 155735 - RNA, 1701 nt, Artificial Sequence; identical to SEQ ID NO: 154954
  derived and/or modified sequence opt4 from hemagglutinin__InfluenzaA__ACU80666

SEQ ID NO: 155736 - RNA, 1701 nt, Artificial Sequence; identical to SEQ ID NO: 154448
  derived and/or modified sequence opt4 from hemagglutinin__InfluenzaA__ACU80677

SEQ ID NO: 155737 - RNA, 1701 nt, Artificial Sequence; identical to SEQ ID NO: 154954
  derived and/or modified sequence opt4 from hemagglutinin__InfluenzaA__ACU80688

SEQ ID NO: 155738 - RNA, 1701 nt, Artificial Sequence; identical to SEQ ID NO: 155057
  derived and/or modified sequence opt4 from hemagglutinin__InfluenzaA__ACU80699

SEQ ID NO: 155739 - RNA, 1701 nt, Artificial Sequence; identical to SEQ ID NO: 155057
  derived and/or modified sequence opt4 from hemagglutinin__InfluenzaA__ACU80710

SEQ ID NO: 155740 - RNA, 1701 nt, Artificial Sequence
  derived and/or modified sequence opt4 from hemagglutinin__InfluenzaA__ACU80721
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaccgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155741 - RNA, 1701 nt, Artificial Sequence; identical to SEQ ID NO: 154954
  derived and/or modified sequence opt4 from hemagglutinin__InfluenzaA__ACU80732

SEQ ID NO: 155742 - RNA, 1701 nt, Artificial Sequence; identical to SEQ ID NO: 154954
  derived and/or modified sequence opt4 from hemagglutinin__InfluenzaA__ACU80743

SEQ ID NO: 155743 - RNA, 1701 nt, Artificial Sequence
  derived and/or modified sequence opt4 from hemagglutinin__InfluenzaA__ACU80754
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 155744 - RNA, 1701 nt, Artificial Sequence
  derived and/or modified sequence opt4 from hemagglutinin__InfluenzaA__ACU80765
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaaguucaaguaccccgcccugaacgugaccaugcccaacaacgaggaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 155745 - RNA, 1701 nt, Artificial Sequence
  derived and/or modified sequence opt4 from hemagglutinin__InfluenzaA__ACU80787
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155746 - RNA, 1701 nt, Artificial Sequence; identical to SEQ ID NO: 154954
  derived and/or modified sequence opt4 from hemagglutinin__InfluenzaA__ACU80798

SEQ ID NO: 155747 - RNA, 1701 nt, Artificial Sequence; identical to SEQ ID NO: 154954
  derived and/or modified sequence opt4 from hemagglutinin__InfluenzaA__ACU81103

SEQ ID NO: 155748 - RNA, 1701 nt, Artificial Sequence
  derived and/or modified sequence opt4 from hemagglutinin__InfluenzaA__ACU87270
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagacagagagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155749 - RNA, 1701 nt, Artificial Sequence; identical to SEQ ID NO: 155189
  derived and/or modified sequence opt4 from hemagglutinin__InfluenzaA__ACV04228

SEQ ID NO: 155750 - RNA, 1701 nt, Artificial Sequence; identical to SEQ ID NO: 155189
  derived and/or modified sequence opt4 from hemagglutinin__InfluenzaA__ACV04238

SEQ ID NO: 155751 - RNA, 1701 nt, Artificial Sequence
  derived and/or modified sequence opt4 from hemagglutinin__InfluenzaA__ACV04248
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcaucaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155752 - RNA, 1701 nt, Artificial Sequence; identical to SEQ ID NO: 155189
  derived and/or modified sequence opt4 from hemagglutinin__InfluenzaA__ACV04258

SEQ ID NO: 155753 - RNA, 1701 nt, Artificial Sequence; identical to SEQ ID NO: 155189
  derived and/or modified sequence opt4 from hemagglutinin__InfluenzaA__ACV04268

SEQ ID NO: 155754 - RNA, 1701 nt, Artificial Sequence; identical to SEQ ID NO: 155189
  derived and/or modified sequence opt4 from hemagglutinin__InfluenzaA__ACV04278

SEQ ID NO: 155755 - RNA, 1701 nt, Artificial Sequence; identical to SEQ ID NO: 155189
  derived and/or modified sequence opt4 from hemagglutinin__InfluenzaA__ACV04288

SEQ ID NO: 155756 - RNA, 1701 nt, Artificial Sequence
  derived and/or modified sequence opt4 from hemagglutinin__InfluenzaA__ACV04298
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccgugaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155757 - RNA, 1701 nt, Artificial Sequence; identical to SEQ ID NO: 155189
  derived and/or modified sequence opt4 from hemagglutinin__InfluenzaA__ACV04308

SEQ ID NO: 155758 - RNA, 1701 nt, Artificial Sequence
  derived and/or modified sequence opt4 from hemagglutinin__InfluenzaA__ACV04318
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155759 - RNA, 1701 nt, Artificial Sequence; identical to SEQ ID NO: 155189
  derived and/or modified sequence opt4 from hemagglutinin__InfluenzaA__ACV04328

SEQ ID NO: 155760 - RNA, 1701 nt, Artificial Sequence; identical to SEQ ID NO: 155189
  derived and/or modified sequence opt4 from hemagglutinin__InfluenzaA__ACV04338

SEQ ID NO: 155761 - RNA, 1701 nt, Artificial Sequence; identical to SEQ ID NO: 155431
  derived and/or modified sequence opt4 from hemagglutinin__InfluenzaA__ACV04358

SEQ ID NO: 155762 - RNA, 1701 nt, Artificial Sequence
  derived and/or modified sequence opt4 from hemagglutinin__InfluenzaA__ACV04368
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugccagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155763 - RNA, 1701 nt, Artificial Sequence
  derived and/or modified sequence opt4 from hemagglutinin__InfluenzaA__ACV04378
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugaucgugagccugggcgccaucagcuucuggaugugcagcaacggcagccugcagugcagaaucugcaucuga

SEQ ID NO: 155764 - RNA, 1701 nt, Artificial Sequence; identical to SEQ ID NO: 155431
  derived and/or modified sequence opt4 from hemagglutinin__InfluenzaA__ACV04388

SEQ ID NO: 155765 - RNA, 1701 nt, Artificial Sequence; identical to SEQ ID NO: 155189
  derived and/or modified sequence opt4 from hemagglutinin__InfluenzaA__ACV04398

SEQ ID NO: 155766 - RNA, 1701 nt, Artificial Sequence; identical to SEQ ID NO: 155433
  derived and/or modified sequence opt4 from hemagglutinin__InfluenzaA__ACV04408

SEQ ID NO: 155767 - RNA, 1701 nt, Artificial Sequence; identical to SEQ ID NO: 155189
  derived and/or modified sequence opt4 from hemagglutinin__InfluenzaA__ACV04489

SEQ ID NO: 155768 - RNA, 1701 nt, Artificial Sequence; identical to SEQ ID NO: 155189
  derived and/or modified sequence opt4 from hemagglutinin__InfluenzaA__ACV04499

SEQ ID NO: 155769 - RNA, 1701 nt, Artificial Sequence; identical to SEQ ID NO: 155369
  derived and/or modified sequence opt4 from hemagglutinin__InfluenzaA__ACV04509

SEQ ID NO: 155770 - RNA, 1701 nt, Artificial Sequence; identical to SEQ ID NO: 155189
  derived and/or modified sequence opt4 from hemagglutinin__InfluenzaA__ACV04519

SEQ ID NO: 155771 - RNA, 1701 nt, Artificial Sequence; identical to SEQ ID NO: 155189
  derived and/or modified sequence opt4 from hemagglutinin__InfluenzaA__ACV04529

SEQ ID NO: 155772 - RNA, 1701 nt, Artificial Sequence; identical to SEQ ID NO: 155189
  derived and/or modified sequence opt4 from hemagglutinin__InfluenzaA__ACV04549

SEQ ID NO: 155773 - RNA, 1701 nt, Artificial Sequence; identical to SEQ ID NO: 155189
  derived and/or modified sequence opt4 from hemagglutinin__InfluenzaA__ACV04559

SEQ ID NO: 155774 - RNA, 1701 nt, Artificial Sequence; identical to SEQ ID NO: 155189
  derived and/or modified sequence opt4 from hemagglutinin__InfluenzaA__ACV04579

SEQ ID NO: 155775 - RNA, 1701 nt, Artificial Sequence
  derived and/or modified sequence opt4 from hemagglutinin__InfluenzaA__ACV04751
auggaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugagacugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacaccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155776 - RNA, 1701 nt, Artificial Sequence
  derived and/or modified sequence opt4 from hemagglutinin__InfluenzaA__ACV04752
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccuggagaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155777 - RNA, 1701 nt, Artificial Sequence
  derived and/or modified sequence opt4 from hemagglutinin__InfluenzaA__ACV04753
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155778 - RNA, 1701 nt, Artificial Sequence
  derived and/or modified sequence opt4 from hemagglutinin__InfluenzaA__ACV04754
auggaggccauccugguggugcugcuguacaccuucgccaccgccaacgccgacacccugugcaucggcuaccacgccaacaacagcaccgacaccguggacaccgugcuggagaagaacgugcccgugacccacagcgugaaccugcugaaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgagagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggcguguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155779 - RNA, 1701 nt, Artificial Sequence; identical to SEQ ID NO: 155674
  derived and/or modified sequence opt4 from hemagglutinin__InfluenzaA__ACV04755

SEQ ID NO: 155780 - RNA, 1701 nt, Artificial Sequence; identical to SEQ ID NO: 155369
  derived and/or modified sequence opt4 from hemagglutinin__InfluenzaA__ACV33084

SEQ ID NO: 155781 - RNA, 1701 nt, Artificial Sequence; identical to SEQ ID NO: 155189
  derived and/or modified sequence opt4 from hemagglutinin__InfluenzaA__ACV33094

SEQ ID NO: 155782 - RNA, 1701 nt, Artificial Sequence; identical to SEQ ID NO: 155189
  derived and/or modified sequence opt4 from hemagglutinin__InfluenzaA__ACV33104

SEQ ID NO: 155783 - RNA, 1701 nt, Artificial Sequence; identical to SEQ ID NO: 155189
  derived and/or modified sequence opt4 from hemagglutinin__InfluenzaA__ACV33114

SEQ ID NO: 155784 - RNA, 1701 nt, Artificial Sequence; identical to SEQ ID NO: 155189
  derived and/or modified sequence opt4 from hemagglutinin__InfluenzaA__ACV33124

SEQ ID NO: 155785 - RNA, 1701 nt, Artificial Sequence; identical to SEQ ID NO: 155189
  derived and/or modified sequence opt4 from hemagglutinin__InfluenzaA__ACV33134

SEQ ID NO: 155786 - RNA, 1701 nt, Artificial Sequence; identical to SEQ ID NO: 155751
  derived and/or modified sequence opt4 from hemagglutinin__InfluenzaA__ACV33144

SEQ ID NO: 155787 - RNA, 1701 nt, Artificial Sequence; identical to SEQ ID NO: 155189
  derived and/or modified sequence opt4 from hemagglutinin__InfluenzaA__ACV33154

SEQ ID NO: 155788 - RNA, 1701 nt, Artificial Sequence; identical to SEQ ID NO: 155189
  derived and/or modified sequence opt4 from hemagglutinin__InfluenzaA__ACV33164

SEQ ID NO: 155789 - RNA, 1701 nt, Artificial Sequence; identical to SEQ ID NO: 155189
  derived and/or modified sequence opt4 from hemagglutinin__InfluenzaA__ACV33174

SEQ ID NO: 155790 - RNA, 1701 nt, Artificial Sequence; identical to SEQ ID NO: 155176
  derived and/or modified sequence opt4 from hemagglutinin__InfluenzaA__ACV41981

SEQ ID NO: 155791 - RNA, 1701 nt, Artificial Sequence; identical to SEQ ID NO: 155215
  derived and/or modified sequence opt4 from hemagglutinin__InfluenzaA__ACV41991

SEQ ID NO: 155792 - RNA, 1701 nt, Artificial Sequence; identical to SEQ ID NO: 155215
  derived and/or modified sequence opt4 from hemagglutinin__InfluenzaA__ACV42001

SEQ ID NO: 155793 - RNA, 1701 nt, Artificial Sequence; identical to SEQ ID NO: 155189
  derived and/or modified sequence opt4 from hemagglutinin__InfluenzaA__ACV42008

SEQ ID NO: 155794 - RNA, 1701 nt, Artificial Sequence; identical to SEQ ID NO: 155189
  derived and/or modified sequence opt4 from hemagglutinin__InfluenzaA__ACV42018

SEQ ID NO: 155795 - RNA, 1701 nt, Artificial Sequence; identical to SEQ ID NO: 154836
  derived and/or modified sequence opt4 from hemagglutinin__InfluenzaA__ACV49501

SEQ ID NO: 155796 - RNA, 1701 nt, Artificial Sequence
  derived and/or modified sequence opt4 from hemagglutinin__InfluenzaA__ACV49512
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucgagagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaaggacguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 155797 - RNA, 1701 nt, Artificial Sequence; identical to SEQ ID NO: 154849
  derived and/or modified sequence opt4 from hemagglutinin__InfluenzaA__ACV49523

SEQ ID NO: 155798 - RNA, 1698 nt, Artificial Sequence
  derived and/or modified sequence opt4 from hemagglutinin__InfluenzaA__ACV49545
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccccaagcugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 155799 - RNA, 1701 nt, Artificial Sequence
  derived and/or modified sequence opt4 from hemagglutinin__InfluenzaA__ACV49556
augaaggccagacugcugauccugcugugcgcccuggccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgacagccugcugcccgccagcagcuggagcuacaucguggagacccccaacagcaagaacggcaucugcuaccccggcgacuucaucgacuacgaggagcugagagagcagcugagcagcgugagcagcuucgagagauucgagaucuuccccaaggagagcagcuggcccaagcacagcaccaccaagggcgugaccgccgccugcagccacgccggcaagagcagcuucuacagaaaccugcuguggcugaccaagaaggaggacagcuaccccaagcugagcaacagcuacgugaacaagaagggcaaggaggugcuggugcuguggggcgugcaccaccccagcagcagcaaggagcagcagacccuguaccagaacgagaacgccuacgugagcguggugagcagcaacuacaacagaagauucauccccgagaucgccgagagacccgaggugaaggaccaggccggcagaaucaacuacuacuggacccugcuggagcccggcgacaccaucaucuucgaggccaacggcaaccugguggcccccugguacgccuucgcccugagcagaggcuucggcagcggcaucaucaccagcaacgccagcaugcacgagugcaacaccaagugccagaccccccagggcgccaucaacagcagccugcccuuccagaacauccaccccgugaccaucggcgagugccccaaguacgugaagagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaaccuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagauccagcugaagaacaacgccaaggagaucggcaacggcugcuucgaguucuaccacaagugcgacaacgagugcauggagagcgugagaaacggcaccuacgacuaccccaaguacagcaaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155800 - RNA, 1701 nt, Artificial Sequence
  derived and/or modified sequence opt4 from hemagglutinin__InfluenzaA__ACV49567
augaaggccaagcugcugauccugcugugcgcccugaccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccugcugagcaagagaagcuggagcuacaucgccgagacccccaacagcgagaacggcgccugcuaccccggcgacuucgccgacuacgaggagcugagagagcagcugagcagcgugagcagcuucgagagauucgagaucuuccccaaggagagaagcuggcccaagcacaacaucaccagaggcgugaccgccgccugcagccacgccggcaagagcagcuucuacaagaaccugcuguggcugaccgagaccgacggcagcuaccccaagcugagcaagagcuacgugaacaacaaggagaaggaggugcuggugcuguggggcgugcaccaccccagcaacaucgaggaccagaagacccuguacagaaaggagaacgccuacgugagcguggugagcagcaacuacaacagaagauucacccccgagaucgccgagagacccaaggugagaggccaggccggcagaaucaacuacuacuggacccugcuggagcccggcgacaccaucaucuucgaggccaacggcaaccugaucgcccccugguacgccuucgcccugagcagagacuucggcagcggcaucaucaccagcaacgccagcauggacgagugcgacaccaagugccagaccccccagggcgccaucaacagcagccugcccuuccagaacauccaccccgugaccaucggcgagugccccaaguacgugaagagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacuggaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugagaaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155801 - RNA, 1689 nt, Artificial Sequence
  derived and/or modified sequence opt4 from hemagglutinin__InfluenzaA__ACV49578
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagagugcccgaguggagcuacaucauggagaaggagaaccccaaguacagccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaagaagggccccaacuaccccguggccaagggcagcuacaacaacaccagcggcgagcagaugcugaucaucuggggcgugcaccaccccaucgacgaggccgagcagaucgcccuguaccagaaggugggcaccuacgugagcgccagcaccagcacccugaacaagagaagcacccccgagaucgccgccagacccgaggugaacggccugggcagcagaauggaguucagcuggacccugcuggacaugugggacaccaucaacuucgagagcaccggcaaccugguggcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagaagagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcauggacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 155802 - RNA, 1689 nt, Artificial Sequence; identical to SEQ ID NO: 155801
  derived and/or modified sequence opt4 from hemagglutinin__InfluenzaA__ACV49589

SEQ ID NO: 155803 - RNA, 1689 nt, Artificial Sequence
  derived and/or modified sequence opt4 from hemagglutinin__InfluenzaA__ACV49600
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccgagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgagaucgccaccagacccaaggugaacggccagggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 155804 - RNA, 1689 nt, Artificial Sequence
  derived and/or modified sequence opt4 from hemagglutinin__InfluenzaA__ACV49611
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccgagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccaagaucgccaccagacccaaggugaacggccagggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagguggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 155805 - RNA, 1701 nt, Artificial Sequence
  derived and/or modified sequence opt4 from hemagglutinin__InfluenzaA__ACV49633
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgugcagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguucccccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 155806 - RNA, 1701 nt, Artificial Sequence; identical to SEQ ID NO: 154876
  derived and/or modified sequence opt4 from hemagglutinin__InfluenzaA__ACV49644

SEQ ID NO: 155807 - RNA, 1698 nt, Artificial Sequence; identical to SEQ ID NO: 155695
  derived and/or modified sequence opt4 from hemagglutinin__InfluenzaA__ACV49676

SEQ ID NO: 155808 - RNA, 1701 nt, Artificial Sequence; identical to SEQ ID NO: 155176
  derived and/or modified sequence opt4 from hemagglutinin__InfluenzaA__ACV53450

SEQ ID NO: 155809 - RNA, 1701 nt, Artificial Sequence; identical to SEQ ID NO: 155176
  derived and/or modified sequence opt4 from hemagglutinin__InfluenzaA__ACV53460

SEQ ID NO: 155810 - RNA, 1701 nt, Artificial Sequence; identical to SEQ ID NO: 155176
  derived and/or modified sequence opt4 from hemagglutinin__InfluenzaA__ACV53480

SEQ ID NO: 155811 - RNA, 1701 nt, Artificial Sequence
  derived and/or modified sequence opt4 from hemagglutinin__InfluenzaA__ACV53490
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcgacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaccagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155812 - RNA, 1701 nt, Artificial Sequence
  derived and/or modified sequence opt4 from hemagglutinin__InfluenzaA__ACV53500
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaccagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155813 - RNA, 1701 nt, Artificial Sequence
  derived and/or modified sequence opt4 from hemagglutinin__InfluenzaA__ACV53880
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155814 - RNA, 1701 nt, Artificial Sequence; identical to SEQ ID NO: 155189
  derived and/or modified sequence opt4 from hemagglutinin__InfluenzaA__ACV53881

SEQ ID NO: 155815 - RNA, 1701 nt, Artificial Sequence; identical to SEQ ID NO: 155176
  derived and/or modified sequence opt4 from hemagglutinin__InfluenzaA__ACV53882

SEQ ID NO: 155816 - RNA, 1701 nt, Artificial Sequence; identical to SEQ ID NO: 155189
  derived and/or modified sequence opt4 from hemagglutinin__InfluenzaA__ACV53883

SEQ ID NO: 155817 - RNA, 1701 nt, Artificial Sequence; identical to SEQ ID NO: 155189
  derived and/or modified sequence opt4 from hemagglutinin__InfluenzaA__ACV53885

SEQ ID NO: 155818 - RNA, 1701 nt, Artificial Sequence
  derived and/or modified sequence opt4 from hemagglutinin__InfluenzaA__ACV53899
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155819 - RNA, 1701 nt, Artificial Sequence; identical to SEQ ID NO: 155189
  derived and/or modified sequence opt4 from hemagglutinin__InfluenzaA__ACV53909

SEQ ID NO: 155820 - RNA, 1701 nt, Artificial Sequence; identical to SEQ ID NO: 155189
  derived and/or modified sequence opt4 from hemagglutinin__InfluenzaA__ACV67220

SEQ ID NO: 155821 - RNA, 1701 nt, Artificial Sequence
  derived and/or modified sequence opt4 from hemagglutinin__InfluenzaA__ACV67221
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcggcagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagagcgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155822 - RNA, 1701 nt, Artificial Sequence; identical to SEQ ID NO: 155176
  derived and/or modified sequence opt4 from hemagglutinin__InfluenzaA__ACV67222

SEQ ID NO: 155823 - RNA, 1701 nt, Artificial Sequence; identical to SEQ ID NO: 155215
  derived and/or modified sequence opt4 from hemagglutinin__InfluenzaA__ACV67223

SEQ ID NO: 155824 - RNA, 1701 nt, Artificial Sequence; identical to SEQ ID NO: 155431
  derived and/or modified sequence opt4 from hemagglutinin__InfluenzaA__ACV67224

SEQ ID NO: 155825 - RNA, 1701 nt, Artificial Sequence; identical to SEQ ID NO: 155369
  derived and/or modified sequence opt4 from hemagglutinin__InfluenzaA__ACV67225

SEQ ID NO: 155826 - RNA, 1701 nt, Artificial Sequence; identical to SEQ ID NO: 155189
  derived and/or modified sequence opt4 from hemagglutinin__InfluenzaA__ACV67226

SEQ ID NO: 155827 - RNA, 1701 nt, Artificial Sequence
  derived and/or modified sequence opt4 from hemagglutinin__InfluenzaA__ACV67227
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcaacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155828 - RNA, 1701 nt, Artificial Sequence; identical to SEQ ID NO: 155431
  derived and/or modified sequence opt4 from hemagglutinin__InfluenzaA__ACV67228

SEQ ID NO: 155829 - RNA, 1701 nt, Artificial Sequence
  derived and/or modified sequence opt4 from hemagglutinin__InfluenzaA__ACV67229
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaaccccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155830 - RNA, 1701 nt, Artificial Sequence; identical to SEQ ID NO: 155176
  derived and/or modified sequence opt4 from hemagglutinin__InfluenzaA__ACV67230

SEQ ID NO: 155831 - RNA, 1701 nt, Artificial Sequence; identical to SEQ ID NO: 155189
  derived and/or modified sequence opt4 from hemagglutinin__InfluenzaA__ACV67231

SEQ ID NO: 155832 - RNA, 1701 nt, Artificial Sequence; identical to SEQ ID NO: 155189
  derived and/or modified sequence opt4 from hemagglutinin__InfluenzaA__ACV67232

SEQ ID NO: 155833 - RNA, 1701 nt, Artificial Sequence; identical to SEQ ID NO: 155176
  derived and/or modified sequence opt4 from hemagglutinin__InfluenzaA__ACV67233

SEQ ID NO: 155834 - RNA, 1701 nt, Artificial Sequence; identical to SEQ ID NO: 155431
  derived and/or modified sequence opt4 from hemagglutinin__InfluenzaA__ACV67234

SEQ ID NO: 155835 - RNA, 1701 nt, Artificial Sequence
  derived and/or modified sequence opt4 from hemagglutinin__InfluenzaA__ACV67235
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaacgagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155836 - RNA, 1701 nt, Artificial Sequence; identical to SEQ ID NO: 155433
  derived and/or modified sequence opt4 from hemagglutinin__InfluenzaA__ACV67236

SEQ ID NO: 155837 - RNA, 1701 nt, Artificial Sequence; identical to SEQ ID NO: 155176
  derived and/or modified sequence opt4 from hemagglutinin__InfluenzaA__ACV67238

SEQ ID NO: 155838 - RNA, 1701 nt, Artificial Sequence
  derived and/or modified sequence opt4 from hemagglutinin__InfluenzaA__ACV67239
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcaacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155839 - RNA, 1701 nt, Artificial Sequence; identical to SEQ ID NO: 155433
  derived and/or modified sequence opt4 from hemagglutinin__InfluenzaA__ACV67240

SEQ ID NO: 155840 - RNA, 1701 nt, Artificial Sequence
  derived and/or modified sequence opt4 from hemagglutinin__InfluenzaA__ACV67241
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaacggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155841 - RNA, 1701 nt, Artificial Sequence; identical to SEQ ID NO: 155431
  derived and/or modified sequence opt4 from hemagglutinin__InfluenzaA__ACV67242

SEQ ID NO: 155842 - RNA, 1701 nt, Artificial Sequence; identical to SEQ ID NO: 155369
  derived and/or modified sequence opt4 from hemagglutinin__InfluenzaA__ACV67244

SEQ ID NO: 155843 - RNA, 1701 nt, Artificial Sequence; identical to SEQ ID NO: 155282
  derived and/or modified sequence opt4 from hemagglutinin__InfluenzaA__ACV67246

SEQ ID NO: 155844 - RNA, 1701 nt, Artificial Sequence; identical to SEQ ID NO: 155813
  derived and/or modified sequence opt4 from hemagglutinin__InfluenzaA__ACV67247

SEQ ID NO: 155845 - RNA, 1701 nt, Artificial Sequence; identical to SEQ ID NO: 155176
  derived and/or modified sequence opt4 from hemagglutinin__InfluenzaA__ACV70073

SEQ ID NO: 155846 - RNA, 1701 nt, Artificial Sequence; identical to SEQ ID NO: 155176
  derived and/or modified sequence opt4 from hemagglutinin__InfluenzaA__ACV70093

SEQ ID NO: 155847 - RNA, 1701 nt, Artificial Sequence; identical to SEQ ID NO: 155176
  derived and/or modified sequence opt4 from hemagglutinin__InfluenzaA__ACV70103

SEQ ID NO: 155848 - RNA, 1701 nt, Artificial Sequence; identical to SEQ ID NO: 155176
  derived and/or modified sequence opt4 from hemagglutinin__InfluenzaA__ACV70113

SEQ ID NO: 155849 - RNA, 1701 nt, Artificial Sequence; identical to SEQ ID NO: 155176
  derived and/or modified sequence opt4 from hemagglutinin__InfluenzaA__ACV70123

SEQ ID NO: 155850 - RNA, 1701 nt, Artificial Sequence; identical to SEQ ID NO: 155176
  derived and/or modified sequence opt4 from hemagglutinin__InfluenzaA__ACV70154

SEQ ID NO: 155851 - RNA, 1701 nt, Artificial Sequence
  derived and/or modified sequence opt4 from hemagglutinin__InfluenzaA__ACV70164
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccugaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155852 - RNA, 1701 nt, Artificial Sequence; identical to SEQ ID NO: 155176
  derived and/or modified sequence opt4 from hemagglutinin__InfluenzaA__ACV70174

SEQ ID NO: 155853 - RNA, 1701 nt, Artificial Sequence; identical to SEQ ID NO: 155176
  derived and/or modified sequence opt4 from hemagglutinin__InfluenzaA__ACV70184

SEQ ID NO: 155854 - RNA, 1701 nt, Artificial Sequence; identical to SEQ ID NO: 155176
  derived and/or modified sequence opt4 from hemagglutinin__InfluenzaA__ACV70194

SEQ ID NO: 155855 - RNA, 1701 nt, Artificial Sequence; identical to SEQ ID NO: 155176
  derived and/or modified sequence opt4 from hemagglutinin__InfluenzaA__ACV70204

SEQ ID NO: 155856 - RNA, 1701 nt, Artificial Sequence; identical to SEQ ID NO: 155176
  derived and/or modified sequence opt4 from hemagglutinin__InfluenzaA__ACV70214

SEQ ID NO: 155857 - RNA, 1701 nt, Artificial Sequence; identical to SEQ ID NO: 155176
  derived and/or modified sequence opt4 from hemagglutinin__InfluenzaA__ACV70224

SEQ ID NO: 155858 - RNA, 1701 nt, Artificial Sequence; identical to SEQ ID NO: 155176
  derived and/or modified sequence opt4 from hemagglutinin__InfluenzaA__ACV70234

SEQ ID NO: 155859 - RNA, 1701 nt, Artificial Sequence; identical to SEQ ID NO: 155176
  derived and/or modified sequence opt4 from hemagglutinin__InfluenzaA__ACV70254

SEQ ID NO: 155860 - RNA, 1701 nt, Artificial Sequence; identical to SEQ ID NO: 155176
  derived and/or modified sequence opt4 from hemagglutinin__InfluenzaA__ACV70264

SEQ ID NO: 155861 - RNA, 1701 nt, Artificial Sequence; identical to SEQ ID NO: 155176
  derived and/or modified sequence opt4 from hemagglutinin__InfluenzaA__ACV70274

SEQ ID NO: 155862 - RNA, 1701 nt, Artificial Sequence; identical to SEQ ID NO: 155176
  derived and/or modified sequence opt4 from hemagglutinin__InfluenzaA__ACV70284

SEQ ID NO: 155863 - RNA, 1701 nt, Artificial Sequence; identical to SEQ ID NO: 155176
  derived and/or modified sequence opt4 from hemagglutinin__InfluenzaA__ACV70294

SEQ ID NO: 155864 - RNA, 1701 nt, Artificial Sequence; identical to SEQ ID NO: 155176
  derived and/or modified sequence opt4 from hemagglutinin__InfluenzaA__ACV70304

SEQ ID NO: 155865 - RNA, 1701 nt, Artificial Sequence; identical to SEQ ID NO: 155851
  derived and/or modified sequence opt4 from hemagglutinin__InfluenzaA__ACV70314

SEQ ID NO: 155866 - RNA, 1701 nt, Artificial Sequence
  derived and/or modified sequence opt4 from hemagglutinin__InfluenzaA__ACV70324
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccuguucaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155867 - RNA, 1701 nt, Artificial Sequence; identical to SEQ ID NO: 155176
  derived and/or modified sequence opt4 from hemagglutinin__InfluenzaA__ACV70334

SEQ ID NO: 155868 - RNA, 1701 nt, Artificial Sequence; identical to SEQ ID NO: 155176
  derived and/or modified sequence opt4 from hemagglutinin__InfluenzaA__ACV70344

SEQ ID NO: 155869 - RNA, 1701 nt, Artificial Sequence; identical to SEQ ID NO: 155176
  derived and/or modified sequence opt4 from hemagglutinin__InfluenzaA__ACV70354

SEQ ID NO: 155870 - RNA, 1701 nt, Artificial Sequence; identical to SEQ ID NO: 155176
  derived and/or modified sequence opt4 from hemagglutinin__InfluenzaA__ACV70364

SEQ ID NO: 155871 - RNA, 1701 nt, Artificial Sequence; identical to SEQ ID NO: 155176
  derived and/or modified sequence opt4 from hemagglutinin__InfluenzaA__ACV70374

SEQ ID NO: 155872 - RNA, 1701 nt, Artificial Sequence; identical to SEQ ID NO: 155176
  derived and/or modified sequence opt4 from hemagglutinin__InfluenzaA__ACV70384

SEQ ID NO: 155873 - RNA, 1701 nt, Artificial Sequence; identical to SEQ ID NO: 155176
  derived and/or modified sequence opt4 from hemagglutinin__InfluenzaA__ACV70394

SEQ ID NO: 155874 - RNA, 1701 nt, Artificial Sequence; identical to SEQ ID NO: 155176
  derived and/or modified sequence opt4 from hemagglutinin__InfluenzaA__ACV70404

SEQ ID NO: 155875 - RNA, 1701 nt, Artificial Sequence; identical to SEQ ID NO: 155851
  derived and/or modified sequence opt4 from hemagglutinin__InfluenzaA__ACV70414

SEQ ID NO: 155876 - RNA, 1701 nt, Artificial Sequence; identical to SEQ ID NO: 155176
  derived and/or modified sequence opt4 from hemagglutinin__InfluenzaA__ACV70424

SEQ ID NO: 155877 - RNA, 1701 nt, Artificial Sequence; identical to SEQ ID NO: 155176
  derived and/or modified sequence opt4 from hemagglutinin__InfluenzaA__ACV70434

SEQ ID NO: 155878 - RNA, 1701 nt, Artificial Sequence; identical to SEQ ID NO: 155176
  derived and/or modified sequence opt4 from hemagglutinin__InfluenzaA__ACV70444

SEQ ID NO: 155879 - RNA, 1701 nt, Artificial Sequence; identical to SEQ ID NO: 155176
  derived and/or modified sequence opt4 from hemagglutinin__InfluenzaA__ACV70454

SEQ ID NO: 155880 - RNA, 1701 nt, Artificial Sequence; identical to SEQ ID NO: 155176
  derived and/or modified sequence opt4 from hemagglutinin__InfluenzaA__ACV70464

SEQ ID NO: 155881 - RNA, 1701 nt, Artificial Sequence; identical to SEQ ID NO: 155176
  derived and/or modified sequence opt4 from hemagglutinin__InfluenzaA__ACV70474

SEQ ID NO: 155882 - RNA, 1701 nt, Artificial Sequence; identical to SEQ ID NO: 155176
  derived and/or modified sequence opt4 from hemagglutinin__InfluenzaA__ACV70484

SEQ ID NO: 155883 - RNA, 1701 nt, Artificial Sequence; identical to SEQ ID NO: 155176
  derived and/or modified sequence opt4 from hemagglutinin__InfluenzaA__ACV70494

SEQ ID NO: 155884 - RNA, 1701 nt, Artificial Sequence; identical to SEQ ID NO: 155176
  derived and/or modified sequence opt4 from hemagglutinin__InfluenzaA__ACV70504

SEQ ID NO: 155885 - RNA, 1701 nt, Artificial Sequence; identical to SEQ ID NO: 155176
  derived and/or modified sequence opt4 from hemagglutinin__InfluenzaA__ACV70514

SEQ ID NO: 155886 - RNA, 1701 nt, Artificial Sequence; identical to SEQ ID NO: 155176
  derived and/or modified sequence opt4 from hemagglutinin__InfluenzaA__ACV70524

SEQ ID NO: 155887 - RNA, 1701 nt, Artificial Sequence; identical to SEQ ID NO: 155369
  derived and/or modified sequence opt4 from hemagglutinin__InfluenzaA__ACV70534

SEQ ID NO: 155888 - RNA, 1701 nt, Artificial Sequence; identical to SEQ ID NO: 155176
  derived and/or modified sequence opt4 from hemagglutinin__InfluenzaA__ACV70544

SEQ ID NO: 155889 - RNA, 1701 nt, Artificial Sequence; identical to SEQ ID NO: 155176
  derived and/or modified sequence opt4 from hemagglutinin__InfluenzaA__ACV70564

SEQ ID NO: 155890 - RNA, 1701 nt, Artificial Sequence; identical to SEQ ID NO: 155176
  derived and/or modified sequence opt4 from hemagglutinin__InfluenzaA__ACV70584

SEQ ID NO: 155891 - RNA, 1701 nt, Artificial Sequence; identical to SEQ ID NO: 155851
  derived and/or modified sequence opt4 from hemagglutinin__InfluenzaA__ACV70594

SEQ ID NO: 155892 - RNA, 1701 nt, Artificial Sequence; identical to SEQ ID NO: 155176
  derived and/or modified sequence opt4 from hemagglutinin__InfluenzaA__ACV70604

SEQ ID NO: 155893 - RNA, 1701 nt, Artificial Sequence; identical to SEQ ID NO: 155176
  derived and/or modified sequence opt4 from hemagglutinin__InfluenzaA__ACV70614

SEQ ID NO: 155894 - RNA, 1701 nt, Artificial Sequence; identical to SEQ ID NO: 155176
  derived and/or modified sequence opt4 from hemagglutinin__InfluenzaA__ACV70624

SEQ ID NO: 155895 - RNA, 1701 nt, Artificial Sequence; identical to SEQ ID NO: 155176
  derived and/or modified sequence opt4 from hemagglutinin__InfluenzaA__ACV70634

SEQ ID NO: 155896 - RNA, 1701 nt, Artificial Sequence; identical to SEQ ID NO: 155176
  derived and/or modified sequence opt4 from hemagglutinin__InfluenzaA__ACV70644

SEQ ID NO: 155897 - RNA, 1701 nt, Artificial Sequence; identical to SEQ ID NO: 155176
  derived and/or modified sequence opt4 from hemagglutinin__InfluenzaA__ACV70654

SEQ ID NO: 155898 - RNA, 1701 nt, Artificial Sequence; identical to SEQ ID NO: 155176
  derived and/or modified sequence opt4 from hemagglutinin__InfluenzaA__ACV70664

SEQ ID NO: 155899 - RNA, 1701 nt, Artificial Sequence; identical to SEQ ID NO: 155176
  derived and/or modified sequence opt4 from hemagglutinin__InfluenzaA__ACV70674

SEQ ID NO: 155900 - RNA, 1701 nt, Artificial Sequence; identical to SEQ ID NO: 155176
  derived and/or modified sequence opt4 from hemagglutinin__InfluenzaA__ACV70684

SEQ ID NO: 155901 - RNA, 1701 nt, Artificial Sequence; identical to SEQ ID NO: 155176
  derived and/or modified sequence opt4 from hemagglutinin__InfluenzaA__ACV70694

SEQ ID NO: 155902 - RNA, 1701 nt, Artificial Sequence; identical to SEQ ID NO: 155176
  derived and/or modified sequence opt4 from hemagglutinin__InfluenzaA__ACV70704

SEQ ID NO: 155903 - RNA, 1701 nt, Artificial Sequence; identical to SEQ ID NO: 155176
  derived and/or modified sequence opt4 from hemagglutinin__InfluenzaA__ACV70714

SEQ ID NO: 155904 - RNA, 1701 nt, Artificial Sequence; identical to SEQ ID NO: 155176
  derived and/or modified sequence opt4 from hemagglutinin__InfluenzaA__ACV70724

SEQ ID NO: 155905 - RNA, 1701 nt, Artificial Sequence; identical to SEQ ID NO: 155813
  derived and/or modified sequence opt4 from hemagglutinin__InfluenzaA__ACV70734

SEQ ID NO: 155906 - RNA, 1701 nt, Artificial Sequence; identical to SEQ ID NO: 155176
  derived and/or modified sequence opt4 from hemagglutinin__InfluenzaA__ACV70744

SEQ ID NO: 155907 - RNA, 1701 nt, Artificial Sequence; identical to SEQ ID NO: 155176
  derived and/or modified sequence opt4 from hemagglutinin__InfluenzaA__ACV70754

SEQ ID NO: 155908 - RNA, 1701 nt, Artificial Sequence; identical to SEQ ID NO: 155176
  derived and/or modified sequence opt4 from hemagglutinin__InfluenzaA__ACV70764

SEQ ID NO: 155909 - RNA, 1701 nt, Artificial Sequence; identical to SEQ ID NO: 155176
  derived and/or modified sequence opt4 from hemagglutinin__InfluenzaA__ACV70784

SEQ ID NO: 155910 - RNA, 1701 nt, Artificial Sequence
  derived and/or modified sequence opt4 from hemagglutinin__InfluenzaA__ACV70794
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgccaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155911 - RNA, 1701 nt, Artificial Sequence; identical to SEQ ID NO: 155176
  derived and/or modified sequence opt4 from hemagglutinin__InfluenzaA__ACV70804

SEQ ID NO: 155912 - RNA, 1701 nt, Artificial Sequence; identical to SEQ ID NO: 155851
  derived and/or modified sequence opt4 from hemagglutinin__InfluenzaA__ACV70824

SEQ ID NO: 155913 - RNA, 1701 nt, Artificial Sequence; identical to SEQ ID NO: 155176
  derived and/or modified sequence opt4 from hemagglutinin__InfluenzaA__ACV70834

SEQ ID NO: 155914 - RNA, 1701 nt, Artificial Sequence
  derived and/or modified sequence opt4 from hemagglutinin__InfluenzaA__ACV70844
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155915 - RNA, 1701 nt, Artificial Sequence; identical to SEQ ID NO: 155176
  derived and/or modified sequence opt4 from hemagglutinin__InfluenzaA__ACV70854

SEQ ID NO: 155916 - RNA, 1701 nt, Artificial Sequence
  derived and/or modified sequence opt4 from hemagglutinin__InfluenzaA__ACV70864
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaccagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155917 - RNA, 1701 nt, Artificial Sequence; identical to SEQ ID NO: 155176
  derived and/or modified sequence opt4 from hemagglutinin__InfluenzaA__ACV70874

SEQ ID NO: 155918 - RNA, 1701 nt, Artificial Sequence; identical to SEQ ID NO: 155369
  derived and/or modified sequence opt4 from hemagglutinin__InfluenzaA__ACV70884

SEQ ID NO: 155919 - RNA, 1701 nt, Artificial Sequence
  derived and/or modified sequence opt4 from hemagglutinin__InfluenzaA__ACV70904
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155920 - RNA, 1701 nt, Artificial Sequence; identical to SEQ ID NO: 155176
  derived and/or modified sequence opt4 from hemagglutinin__InfluenzaA__ACV70914

SEQ ID NO: 155921 - RNA, 1701 nt, Artificial Sequence; identical to SEQ ID NO: 155176
  derived and/or modified sequence opt4 from hemagglutinin__InfluenzaA__ACV70924

SEQ ID NO: 155922 - RNA, 1701 nt, Artificial Sequence; identical to SEQ ID NO: 155176
  derived and/or modified sequence opt4 from hemagglutinin__InfluenzaA__ACV70934

SEQ ID NO: 155923 - RNA, 1701 nt, Artificial Sequence; identical to SEQ ID NO: 155176
  derived and/or modified sequence opt4 from hemagglutinin__InfluenzaA__ACV70944

SEQ ID NO: 155924 - RNA, 1701 nt, Artificial Sequence
  derived and/or modified sequence opt4 from hemagglutinin__InfluenzaA__ACV70954
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155925 - RNA, 1701 nt, Artificial Sequence; identical to SEQ ID NO: 155176
  derived and/or modified sequence opt4 from hemagglutinin__InfluenzaA__ACV70964

SEQ ID NO: 155926 - RNA, 1701 nt, Artificial Sequence; identical to SEQ ID NO: 155176
  derived and/or modified sequence opt4 from hemagglutinin__InfluenzaA__ACV70974

SEQ ID NO: 155927 - RNA, 1701 nt, Artificial Sequence; identical to SEQ ID NO: 155919
  derived and/or modified sequence opt4 from hemagglutinin__InfluenzaA__ACV70984

SEQ ID NO: 155928 - RNA, 1701 nt, Artificial Sequence; identical to SEQ ID NO: 155924
  derived and/or modified sequence opt4 from hemagglutinin__InfluenzaA__ACV70994

SEQ ID NO: 155929 - RNA, 1701 nt, Artificial Sequence; identical to SEQ ID NO: 155176
  derived and/or modified sequence opt4 from hemagglutinin__InfluenzaA__ACV71004

SEQ ID NO: 155930 - RNA, 1701 nt, Artificial Sequence
  derived and/or modified sequence opt4 from hemagglutinin__InfluenzaA__ACV82230
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagccaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccaggcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155931 - RNA, 1701 nt, Artificial Sequence
  derived and/or modified sequence opt4 from hemagglutinin__InfluenzaA__ACV82232
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155932 - RNA, 1698 nt, Artificial Sequence
  derived and/or modified sequence opt4 from hemagglutinin__InfluenzaA__ACV82233
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacaaccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaagaucagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155933 - RNA, 1701 nt, Artificial Sequence
  derived and/or modified sequence opt4 from hemagglutinin__InfluenzaA__ACV83662
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggugagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155934 - RNA, 1701 nt, Artificial Sequence
  derived and/or modified sequence opt4 from hemagglutinin__InfluenzaA__ACV83663
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155935 - RNA, 1701 nt, Artificial Sequence; identical to SEQ ID NO: 155934
  derived and/or modified sequence opt4 from hemagglutinin__InfluenzaA__ACV83664

SEQ ID NO: 155936 - RNA, 1701 nt, Artificial Sequence
  derived and/or modified sequence opt4 from hemagglutinin__InfluenzaA__ACV83665
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaucgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155937 - RNA, 1701 nt, Artificial Sequence
  derived and/or modified sequence opt4 from hemagglutinin__InfluenzaA__ACV83667
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaaaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155938 - RNA, 1701 nt, Artificial Sequence; identical to SEQ ID NO: 155189
  derived and/or modified sequence opt4 from hemagglutinin__InfluenzaA__ACV83668

SEQ ID NO: 155939 - RNA, 1701 nt, Artificial Sequence; identical to SEQ ID NO: 155189
  derived and/or modified sequence opt4 from hemagglutinin__InfluenzaA__ACV83670

SEQ ID NO: 155940 - RNA, 1701 nt, Artificial Sequence; identical to SEQ ID NO: 155431
  derived and/or modified sequence opt4 from hemagglutinin__InfluenzaA__ACV83671

SEQ ID NO: 155941 - RNA, 1701 nt, Artificial Sequence; identical to SEQ ID NO: 155751
  derived and/or modified sequence opt4 from hemagglutinin__InfluenzaA__ACV88399

SEQ ID NO: 155942 - RNA, 1701 nt, Artificial Sequence; identical to SEQ ID NO: 155751
  derived and/or modified sequence opt4 from hemagglutinin__InfluenzaA__ACV88409

SEQ ID NO: 155943 - RNA, 1701 nt, Artificial Sequence; identical to SEQ ID NO: 155176
  derived and/or modified sequence opt4 from hemagglutinin__InfluenzaA__ACV88419

SEQ ID NO: 155944 - RNA, 1698 nt, Artificial Sequence; identical to SEQ ID NO: 155798
  derived and/or modified sequence opt4 from hemagglutinin__InfluenzaA__ACV89502

SEQ ID NO: 155945 - RNA, 1701 nt, Artificial Sequence
  derived and/or modified sequence opt4 from hemagglutinin__InfluenzaA__ACV89516
augaaggccagacugcugauccugcugugcgcccuggccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgacagccugcugcccgccagcagcuggagcuacaucguggagacccccaacagcaagaacggcaucugcuaccccggcgacuucaucgacuacgaggagcugagagagcagcugagcagcgugagcagcuucgagagauucgagaucuuccccaaggagagcagcuggcccaagcacagcaccaccaagggcgugaccgccgccugcagccacgccggcaagagcagcuucuacagaaaccugcuguggcugaccaagaagggcgacagcuaccccaagcugagcaacagcuacgugaacaagaagggcaaggaggugcuggugcuguggggcgugcaccaccccagcagcagcaaggagcagcagacccuguaccagaacgagaacgccuacgugagcguggugagcagcaacuacaacagaagauucauccccgagaucgccgagagacccgaggugaaggaccaggccggcagaaucaacuacuacuggacccugcuggagcccggcgacaccaucaucuucgaggccaacggcaaccugguggcccccugguacgccuucgcccugagcagaggcuucggcagcggcaucaucaccagcaacgccagcaugcacgagugcaacaccaagugccagaccccccagggcgccaucaacagcagccugcccuuccagaacauccaccccgugaccaucggcgagugccccaaguacgugaagagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaaccuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagauccagcugaagaacaacgccaaggagaucggcaacggcugcuucgaguucuaccacaagugcgacaacgagugcauggagagcgugagaaacggcaccuacgacuaccccaaguacagcaaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155946 - RNA, 1698 nt, Artificial Sequence
  derived and/or modified sequence opt4 from hemagglutinin__InfluenzaA__ACV90512
augaacgugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccaucgacaagugggacgccaagugccagaccccccagggcgccaucaacagcagccugcccuuccagaacgugcaccccgugaccaucggcgaguggcccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaagaugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugacccuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 155947 - RNA, 1701 nt, Artificial Sequence; identical to SEQ ID NO: 155189
  derived and/or modified sequence opt4 from hemagglutinin__InfluenzaA__ACV91672

SEQ ID NO: 155948 - RNA, 1701 nt, Artificial Sequence; identical to SEQ ID NO: 155189
  derived and/or modified sequence opt4 from hemagglutinin__InfluenzaA__ACV91676

SEQ ID NO: 155949 - RNA, 1701 nt, Artificial Sequence; identical to SEQ ID NO: 155189
  derived and/or modified sequence opt4 from hemagglutinin__InfluenzaA__ACV91680

SEQ ID NO: 155950 - RNA, 1701 nt, Artificial Sequence
  derived and/or modified sequence opt4 from hemagglutinin__InfluenzaA__ACX31591
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccaggcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 155951 - RNA, 1701 nt, Artificial Sequence
  derived and/or modified sequence opt4 from hemagglutinin__InfluenzaA__ACX31933
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucaacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155952 - RNA, 1701 nt, Artificial Sequence
  derived and/or modified sequence opt4 from hemagglutinin__InfluenzaA__ACX31934
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucaccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155953 - RNA, 1701 nt, Artificial Sequence; identical to SEQ ID NO: 155189
  derived and/or modified sequence opt4 from hemagglutinin__InfluenzaA__ACX31935

SEQ ID NO: 155954 - RNA, 1701 nt, Artificial Sequence; identical to SEQ ID NO: 155189
  derived and/or modified sequence opt4 from hemagglutinin__InfluenzaA__ACX31936

SEQ ID NO: 155955 - RNA, 1701 nt, Artificial Sequence; identical to SEQ ID NO: 155280
  derived and/or modified sequence opt4 from hemagglutinin__InfluenzaA__ACX31939

SEQ ID NO: 155956 - RNA, 1701 nt, Artificial Sequence; identical to SEQ ID NO: 155280
  derived and/or modified sequence opt4 from hemagglutinin__InfluenzaA__ACX31940

SEQ ID NO: 155957 - RNA, 1701 nt, Artificial Sequence; identical to SEQ ID NO: 155189
  derived and/or modified sequence opt4 from hemagglutinin__InfluenzaA__ACX31943

SEQ ID NO: 155958 - RNA, 1701 nt, Artificial Sequence; identical to SEQ ID NO: 155189
  derived and/or modified sequence opt4 from hemagglutinin__InfluenzaA__ACX31946

SEQ ID NO: 155959 - RNA, 1701 nt, Artificial Sequence; identical to SEQ ID NO: 155189
  derived and/or modified sequence opt4 from hemagglutinin__InfluenzaA__ACX31947

SEQ ID NO: 155960 - RNA, 1701 nt, Artificial Sequence; identical to SEQ ID NO: 155189
  derived and/or modified sequence opt4 from hemagglutinin__InfluenzaA__ACX31948

SEQ ID NO: 155961 - RNA, 1701 nt, Artificial Sequence
  derived and/or modified sequence opt4 from hemagglutinin__InfluenzaA__ACX31949
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacuacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgaggaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155962 - RNA, 1701 nt, Artificial Sequence; identical to SEQ ID NO: 155189
  derived and/or modified sequence opt4 from hemagglutinin__InfluenzaA__ACX31950

SEQ ID NO: 155963 - RNA, 1701 nt, Artificial Sequence; identical to SEQ ID NO: 155189
  derived and/or modified sequence opt4 from hemagglutinin__InfluenzaA__ACX31951

SEQ ID NO: 155964 - RNA, 1701 nt, Artificial Sequence; identical to SEQ ID NO: 155189
  derived and/or modified sequence opt4 from hemagglutinin__InfluenzaA__ACX31954

SEQ ID NO: 155965 - RNA, 1701 nt, Artificial Sequence; identical to SEQ ID NO: 155189
  derived and/or modified sequence opt4 from hemagglutinin__InfluenzaA__ACX31955

SEQ ID NO: 155966 - RNA, 1701 nt, Artificial Sequence; identical to SEQ ID NO: 155176
  derived and/or modified sequence opt4 from hemagglutinin__InfluenzaA__ACX31956

SEQ ID NO: 155967 - RNA, 1701 nt, Artificial Sequence; identical to SEQ ID NO: 155189
  derived and/or modified sequence opt4 from hemagglutinin__InfluenzaA__ACX31957

SEQ ID NO: 155968 - RNA, 1701 nt, Artificial Sequence; identical to SEQ ID NO: 155176
  derived and/or modified sequence opt4 from hemagglutinin__InfluenzaA__ACX31958

SEQ ID NO: 155969 - RNA, 1701 nt, Artificial Sequence; identical to SEQ ID NO: 155431
  derived and/or modified sequence opt4 from hemagglutinin__InfluenzaA__ACX31960

SEQ ID NO: 155970 - RNA, 1701 nt, Artificial Sequence
  derived and/or modified sequence opt4 from hemagglutinin__InfluenzaA__ACX31961
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuucauggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155971 - RNA, 1701 nt, Artificial Sequence; identical to SEQ ID NO: 155189
  derived and/or modified sequence opt4 from hemagglutinin__InfluenzaA__ACX31962

SEQ ID NO: 155972 - RNA, 1701 nt, Artificial Sequence; identical to SEQ ID NO: 155189
  derived and/or modified sequence opt4 from hemagglutinin__InfluenzaA__ACX31964

SEQ ID NO: 155973 - RNA, 1701 nt, Artificial Sequence; identical to SEQ ID NO: 155176
  derived and/or modified sequence opt4 from hemagglutinin__InfluenzaA__ACX35237

SEQ ID NO: 155974 - RNA, 1701 nt, Artificial Sequence; identical to SEQ ID NO: 155189
  derived and/or modified sequence opt4 from hemagglutinin__InfluenzaA__ACX35247

SEQ ID NO: 155975 - RNA, 1701 nt, Artificial Sequence; identical to SEQ ID NO: 155189
  derived and/or modified sequence opt4 from hemagglutinin__InfluenzaA__ACX35257

SEQ ID NO: 155976 - RNA, 1701 nt, Artificial Sequence; identical to SEQ ID NO: 155189
  derived and/or modified sequence opt4 from hemagglutinin__InfluenzaA__ACX35267

SEQ ID NO: 155977 - RNA, 1701 nt, Artificial Sequence; identical to SEQ ID NO: 155189
  derived and/or modified sequence opt4 from hemagglutinin__InfluenzaA__ACX35277

SEQ ID NO: 155978 - RNA, 1701 nt, Artificial Sequence; identical to SEQ ID NO: 155189
  derived and/or modified sequence opt4 from hemagglutinin__InfluenzaA__ACX35287

SEQ ID NO: 155979 - RNA, 1701 nt, Artificial Sequence; identical to SEQ ID NO: 155189
  derived and/or modified sequence opt4 from hemagglutinin__InfluenzaA__ACX35297

SEQ ID NO: 155980 - RNA, 1701 nt, Artificial Sequence
  derived and/or modified sequence opt4 from hemagglutinin__InfluenzaA__ACX35307
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccuggugggccccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155981 - RNA, 1701 nt, Artificial Sequence; identical to SEQ ID NO: 155431
  derived and/or modified sequence opt4 from hemagglutinin__InfluenzaA__ACX35317

SEQ ID NO: 155982 - RNA, 1701 nt, Artificial Sequence
  derived and/or modified sequence opt4 from hemagglutinin__InfluenzaA__ACX35327
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacagcuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155983 - RNA, 1701 nt, Artificial Sequence
  derived and/or modified sequence opt4 from hemagglutinin__InfluenzaA__ACX36501
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagcaucuaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155984 - RNA, 1701 nt, Artificial Sequence
  derived and/or modified sequence opt4 from hemagglutinin__InfluenzaA__ACX36502
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagcaucuaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155985 - RNA, 1701 nt, Artificial Sequence
  derived and/or modified sequence opt4 from hemagglutinin__InfluenzaA__ACX36503
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagcaucuaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacaccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155986 - RNA, 1701 nt, Artificial Sequence
  derived and/or modified sequence opt4 from hemagglutinin__InfluenzaA__ACX47367
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccuggugaagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155987 - RNA, 1701 nt, Artificial Sequence
  derived and/or modified sequence opt4 from hemagglutinin__InfluenzaA__ACX47368
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155988 - RNA, 1701 nt, Artificial Sequence; identical to SEQ ID NO: 155987
  derived and/or modified sequence opt4 from hemagglutinin__InfluenzaA__ACX47369

SEQ ID NO: 155989 - RNA, 1701 nt, Artificial Sequence
  derived and/or modified sequence opt4 from hemagglutinin__InfluenzaA__ACX47370
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgacagacagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155990 - RNA, 1701 nt, Artificial Sequence; identical to SEQ ID NO: 155987
  derived and/or modified sequence opt4 from hemagglutinin__InfluenzaA__ACX47371

SEQ ID NO: 155991 - RNA, 1701 nt, Artificial Sequence; identical to SEQ ID NO: 155987
  derived and/or modified sequence opt4 from hemagglutinin__InfluenzaA__ACX47372

SEQ ID NO: 155992 - RNA, 1701 nt, Artificial Sequence; identical to SEQ ID NO: 155987
  derived and/or modified sequence opt4 from hemagglutinin__InfluenzaA__ACX47373

SEQ ID NO: 155993 - RNA, 1701 nt, Artificial Sequence; identical to SEQ ID NO: 155987
  derived and/or modified sequence opt4 from hemagglutinin__InfluenzaA__ACX47374

SEQ ID NO: 155994 - RNA, 1701 nt, Artificial Sequence
  derived and/or modified sequence opt4 from hemagglutinin__InfluenzaA__ACX47375
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaacggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155995 - RNA, 1701 nt, Artificial Sequence; identical to SEQ ID NO: 155987
  derived and/or modified sequence opt4 from hemagglutinin__InfluenzaA__ACX47376

SEQ ID NO: 155996 - RNA, 1701 nt, Artificial Sequence; identical to SEQ ID NO: 155987
  derived and/or modified sequence opt4 from hemagglutinin__InfluenzaA__ACX47377

SEQ ID NO: 155997 - RNA, 1701 nt, Artificial Sequence
  derived and/or modified sequence opt4 from hemagglutinin__InfluenzaA__ACX47380
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccaccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgugauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 155998 - RNA, 1701 nt, Artificial Sequence; identical to SEQ ID NO: 155997
  derived and/or modified sequence opt4 from hemagglutinin__InfluenzaA__ACX47381

SEQ ID NO: 155999 - RNA, 1701 nt, Artificial Sequence; identical to SEQ ID NO: 155997
  derived and/or modified sequence opt4 from hemagglutinin__InfluenzaA__ACX47382

SEQ ID NO: 156000 - RNA, 1701 nt, Artificial Sequence
  derived and/or modified sequence opt4 from hemagglutinin__InfluenzaA__ACX47383
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccaccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156001 - RNA, 1701 nt, Artificial Sequence
  derived and/or modified sequence opt4 from hemagglutinin__InfluenzaA__ACX47384
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccaccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156002 - RNA, 1701 nt, Artificial Sequence; identical to SEQ ID NO: 156001
  derived and/or modified sequence opt4 from hemagglutinin__InfluenzaA__ACX47385

SEQ ID NO: 156003 - RNA, 1701 nt, Artificial Sequence; identical to SEQ ID NO: 156001
  derived and/or modified sequence opt4 from hemagglutinin__InfluenzaA__ACX47387

SEQ ID NO: 156004 - RNA, 1701 nt, Artificial Sequence; identical to SEQ ID NO: 155189
  derived and/or modified sequence opt4 from hemagglutinin__InfluenzaA__ACX55834

SEQ ID NO: 156005 - RNA, 1701 nt, Artificial Sequence; identical to SEQ ID NO: 155987
  derived and/or modified sequence opt4 from hemagglutinin__InfluenzaA__ACX61574

SEQ ID NO: 156006 - RNA, 1701 nt, Artificial Sequence; identical to SEQ ID NO: 155189
  derived and/or modified sequence opt4 from hemagglutinin__InfluenzaA__ACX61575

SEQ ID NO: 156007 - RNA, 1701 nt, Artificial Sequence
  derived and/or modified sequence opt4 from hemagglutinin__InfluenzaA__ACX83577
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagcuucagcaccagcagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156008 - RNA, 1701 nt, Artificial Sequence
  derived and/or modified sequence opt4 from hemagglutinin__InfluenzaA__ACX94091
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccaucagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugcagcaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156009 - RNA, 1701 nt, Artificial Sequence
  derived and/or modified sequence opt4 from hemagglutinin__InfluenzaA__ACY26192
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccaggacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156010 - RNA, 1701 nt, Artificial Sequence; identical to SEQ ID NO: 155758
  derived and/or modified sequence opt4 from hemagglutinin__InfluenzaA__ACY26202

SEQ ID NO: 156011 - RNA, 1701 nt, Artificial Sequence; identical to SEQ ID NO: 155189
  derived and/or modified sequence opt4 from hemagglutinin__InfluenzaA__ACY46103

SEQ ID NO: 156012 - RNA, 1701 nt, Artificial Sequence; identical to SEQ ID NO: 155189
  derived and/or modified sequence opt4 from hemagglutinin__InfluenzaA__ACY46113

SEQ ID NO: 156013 - RNA, 1701 nt, Artificial Sequence
  derived and/or modified sequence opt4 from hemagglutinin__InfluenzaA__ACY46123
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugggcgaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156014 - RNA, 1701 nt, Artificial Sequence; identical to SEQ ID NO: 155189
  derived and/or modified sequence opt4 from hemagglutinin__InfluenzaA__ACY46133

SEQ ID NO: 156015 - RNA, 1701 nt, Artificial Sequence; identical to SEQ ID NO: 155189
  derived and/or modified sequence opt4 from hemagglutinin__InfluenzaA__ACY46163

SEQ ID NO: 156016 - RNA, 1701 nt, Artificial Sequence
  derived and/or modified sequence opt4 from hemagglutinin__InfluenzaA__ACY46173
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156017 - RNA, 1701 nt, Artificial Sequence; identical to SEQ ID NO: 155189
  derived and/or modified sequence opt4 from hemagglutinin__InfluenzaA__ACY46213

SEQ ID NO: 156018 - RNA, 1701 nt, Artificial Sequence; identical to SEQ ID NO: 155189
  derived and/or modified sequence opt4 from hemagglutinin__InfluenzaA__ACY46223

SEQ ID NO: 156019 - RNA, 1701 nt, Artificial Sequence; identical to SEQ ID NO: 155189
  derived and/or modified sequence opt4 from hemagglutinin__InfluenzaA__ACY46233

SEQ ID NO: 156020 - RNA, 1701 nt, Artificial Sequence; identical to SEQ ID NO: 155189
  derived and/or modified sequence opt4 from hemagglutinin__InfluenzaA__ACY46243

SEQ ID NO: 156021 - RNA, 1701 nt, Artificial Sequence; identical to SEQ ID NO: 155189
  derived and/or modified sequence opt4 from hemagglutinin__InfluenzaA__ACY46253

SEQ ID NO: 156022 - RNA, 1701 nt, Artificial Sequence; identical to SEQ ID NO: 155189
  derived and/or modified sequence opt4 from hemagglutinin__InfluenzaA__ACY46263

SEQ ID NO: 156023 - RNA, 1701 nt, Artificial Sequence; identical to SEQ ID NO: 155189
  derived and/or modified sequence opt4 from hemagglutinin__InfluenzaA__ACY46273

SEQ ID NO: 156024 - RNA, 1701 nt, Artificial Sequence; identical to SEQ ID NO: 155189
  derived and/or modified sequence opt4 from hemagglutinin__InfluenzaA__ACY46283

SEQ ID NO: 156025 - RNA, 1701 nt, Artificial Sequence
  derived and/or modified sequence opt4 from hemagglutinin__InfluenzaA__ACY46293
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccgccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156026 - RNA, 1701 nt, Artificial Sequence; identical to SEQ ID NO: 155189
  derived and/or modified sequence opt4 from hemagglutinin__InfluenzaA__ACY46303

SEQ ID NO: 156027 - RNA, 1701 nt, Artificial Sequence; identical to SEQ ID NO: 155189
  derived and/or modified sequence opt4 from hemagglutinin__InfluenzaA__ACY46313

SEQ ID NO: 156028 - RNA, 1701 nt, Artificial Sequence; identical to SEQ ID NO: 155189
  derived and/or modified sequence opt4 from hemagglutinin__InfluenzaA__ACY46323

SEQ ID NO: 156029 - RNA, 1701 nt, Artificial Sequence; identical to SEQ ID NO: 155189
  derived and/or modified sequence opt4 from hemagglutinin__InfluenzaA__ACY46343

SEQ ID NO: 156030 - RNA, 1701 nt, Artificial Sequence; identical to SEQ ID NO: 155189
  derived and/or modified sequence opt4 from hemagglutinin__InfluenzaA__ACY46353

SEQ ID NO: 156031 - RNA, 1701 nt, Artificial Sequence
  derived and/or modified sequence opt4 from hemagglutinin__InfluenzaA__ACY46373
augaaggccauccugaucgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156032 - RNA, 1701 nt, Artificial Sequence
  derived and/or modified sequence opt4 from hemagglutinin__InfluenzaA__ACY46383
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156033 - RNA, 1701 nt, Artificial Sequence; identical to SEQ ID NO: 155189
  derived and/or modified sequence opt4 from hemagglutinin__InfluenzaA__ACY46393

SEQ ID NO: 156034 - RNA, 1701 nt, Artificial Sequence; identical to SEQ ID NO: 155189
  derived and/or modified sequence opt4 from hemagglutinin__InfluenzaA__ACY46403

SEQ ID NO: 156035 - RNA, 1701 nt, Artificial Sequence; identical to SEQ ID NO: 155189
  derived and/or modified sequence opt4 from hemagglutinin__InfluenzaA__ACY46413

SEQ ID NO: 156036 - RNA, 1701 nt, Artificial Sequence; identical to SEQ ID NO: 155189
  derived and/or modified sequence opt4 from hemagglutinin__InfluenzaA__ACY46433

SEQ ID NO: 156037 - RNA, 1701 nt, Artificial Sequence; identical to SEQ ID NO: 155189
  derived and/or modified sequence opt4 from hemagglutinin__InfluenzaA__ACY46443

SEQ ID NO: 156038 - RNA, 1701 nt, Artificial Sequence; identical to SEQ ID NO: 155189
  derived and/or modified sequence opt4 from hemagglutinin__InfluenzaA__ACY46453

SEQ ID NO: 156039 - RNA, 1701 nt, Artificial Sequence
  derived and/or modified sequence opt4 from hemagglutinin__InfluenzaA__ACY46463
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggugagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156040 - RNA, 1701 nt, Artificial Sequence; identical to SEQ ID NO: 155189
  derived and/or modified sequence opt4 from hemagglutinin__InfluenzaA__ACY46473

SEQ ID NO: 156041 - RNA, 1701 nt, Artificial Sequence; identical to SEQ ID NO: 155176
  derived and/or modified sequence opt4 from hemagglutinin__InfluenzaA__ACY46493

SEQ ID NO: 156042 - RNA, 1701 nt, Artificial Sequence
  derived and/or modified sequence opt4 from hemagglutinin__InfluenzaA__ACY46513
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggacaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156043 - RNA, 1701 nt, Artificial Sequence; identical to SEQ ID NO: 155189
  derived and/or modified sequence opt4 from hemagglutinin__InfluenzaA__ACY46523

SEQ ID NO: 156044 - RNA, 1701 nt, Artificial Sequence; identical to SEQ ID NO: 155189
  derived and/or modified sequence opt4 from hemagglutinin__InfluenzaA__ACY46533

SEQ ID NO: 156045 - RNA, 1701 nt, Artificial Sequence; identical to SEQ ID NO: 155189
  derived and/or modified sequence opt4 from hemagglutinin__InfluenzaA__ACY46562

SEQ ID NO: 156046 - RNA, 1701 nt, Artificial Sequence; identical to SEQ ID NO: 155189
  derived and/or modified sequence opt4 from hemagglutinin__InfluenzaA__ACY46572

SEQ ID NO: 156047 - RNA, 1701 nt, Artificial Sequence; identical to SEQ ID NO: 155189
  derived and/or modified sequence opt4 from hemagglutinin__InfluenzaA__ACY46582

SEQ ID NO: 156048 - RNA, 1701 nt, Artificial Sequence; identical to SEQ ID NO: 155189
  derived and/or modified sequence opt4 from hemagglutinin__InfluenzaA__ACY46592

SEQ ID NO: 156049 - RNA, 1701 nt, Artificial Sequence; identical to SEQ ID NO: 155189
  derived and/or modified sequence opt4 from hemagglutinin__InfluenzaA__ACY46622

SEQ ID NO: 156050 - RNA, 1701 nt, Artificial Sequence
  derived and/or modified sequence opt4 from hemagglutinin__InfluenzaA__ACY46672
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggugagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156051 - RNA, 1701 nt, Artificial Sequence; identical to SEQ ID NO: 155189
  derived and/or modified sequence opt4 from hemagglutinin__InfluenzaA__ACY46682

SEQ ID NO: 156052 - RNA, 1701 nt, Artificial Sequence; identical to SEQ ID NO: 155189
  derived and/or modified sequence opt4 from hemagglutinin__InfluenzaA__ACY46692

SEQ ID NO: 156053 - RNA, 1701 nt, Artificial Sequence; identical to SEQ ID NO: 155189
  derived and/or modified sequence opt4 from hemagglutinin__InfluenzaA__ACY46712

SEQ ID NO: 156054 - RNA, 1701 nt, Artificial Sequence
  derived and/or modified sequence opt4 from hemagglutinin__InfluenzaA__ACY46722
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccggccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156055 - RNA, 1701 nt, Artificial Sequence
  derived and/or modified sequence opt4 from hemagglutinin__InfluenzaA__ACY46742
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcaacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156056 - RNA, 1701 nt, Artificial Sequence; identical to SEQ ID NO: 155189
  derived and/or modified sequence opt4 from hemagglutinin__InfluenzaA__ACY46762

SEQ ID NO: 156057 - RNA, 1701 nt, Artificial Sequence; identical to SEQ ID NO: 155189
  derived and/or modified sequence opt4 from hemagglutinin__InfluenzaA__ACY46772

SEQ ID NO: 156058 - RNA, 1701 nt, Artificial Sequence; identical to SEQ ID NO: 155189
  derived and/or modified sequence opt4 from hemagglutinin__InfluenzaA__ACY46903

SEQ ID NO: 156059 - RNA, 1701 nt, Artificial Sequence; identical to SEQ ID NO: 155215
  derived and/or modified sequence opt4 from hemagglutinin__InfluenzaA__ACY77534

SEQ ID NO: 156060 - RNA, 1698 nt, Artificial Sequence
  derived and/or modified sequence opt4 from hemagglutinin__InfluenzaA__ACY77544
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccaccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcuggagccugcagugcagaaucugcaucuga

SEQ ID NO: 156061 - RNA, 1698 nt, Artificial Sequence
  derived and/or modified sequence opt4 from hemagglutinin__InfluenzaA__ACY77554
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccaccugcagugcagaaucugcaucuga

SEQ ID NO: 156062 - RNA, 1695 nt, Artificial Sequence
  derived and/or modified sequence opt4 from hemagglutinin__InfluenzaA__ACY77573
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagagcgccaucgacgagaucaccaacaaggugaacagcgugaucgagaagaugaacacccagcugaccggccagugcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaacgagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcugcagaaucugcaucuga

SEQ ID NO: 156063 - RNA, 1701 nt, Artificial Sequence
  derived and/or modified sequence opt4 from hemagglutinin__InfluenzaA__ACY77593
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccaccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156064 - RNA, 1698 nt, Artificial Sequence
  derived and/or modified sequence opt4 from hemagglutinin__InfluenzaA__ACY77603
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcuggagccugcagugcagaaucugcaucuga

SEQ ID NO: 156065 - RNA, 1695 nt, Artificial Sequence
  derived and/or modified sequence opt4 from hemagglutinin__InfluenzaA__ACY77613
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccggccagugcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcugcagaaucugcaucuga

SEQ ID NO: 156066 - RNA, 1701 nt, Artificial Sequence; identical to SEQ ID NO: 155189
  derived and/or modified sequence opt4 from hemagglutinin__InfluenzaA__ACY77623

SEQ ID NO: 156067 - RNA, 1707 nt, Artificial Sequence
  derived and/or modified sequence opt4 from hemagglutinin__InfluenzaA__ACY77653
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcggcagccugcagugcagaaucugcaucuga

SEQ ID NO: 156068 - RNA, 1698 nt, Artificial Sequence
  derived and/or modified sequence opt4 from hemagglutinin__InfluenzaA__ACY77663
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcuggagccugcugugcagaaucugcaucuga

SEQ ID NO: 156069 - RNA, 1698 nt, Artificial Sequence
  derived and/or modified sequence opt4 from hemagglutinin__InfluenzaA__ACY77683
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcuggagccugcagugcagaaucugcaucuga

SEQ ID NO: 156070 - RNA, 1698 nt, Artificial Sequence
  derived and/or modified sequence opt4 from hemagglutinin__InfluenzaA__ACY77693
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucaccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccggccagugcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcuggagccugcagugcagaaucugcaucuga

SEQ ID NO: 156071 - RNA, 1698 nt, Artificial Sequence
  derived and/or modified sequence opt4 from hemagglutinin__InfluenzaA__ACY77703
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccggccagugcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcuggagccugcagugcagaaucugcaucuga

SEQ ID NO: 156072 - RNA, 1698 nt, Artificial Sequence
  derived and/or modified sequence opt4 from hemagglutinin__InfluenzaA__ACY77713
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccggccagugcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccaccugcagugcagaaucugcaucuga

SEQ ID NO: 156073 - RNA, 1701 nt, Artificial Sequence; identical to SEQ ID NO: 155502
  derived and/or modified sequence opt4 from hemagglutinin__InfluenzaA__ACY77723

SEQ ID NO: 156074 - RNA, 1695 nt, Artificial Sequence
  derived and/or modified sequence opt4 from hemagglutinin__InfluenzaA__ACY77733
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaccggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccugcagugcagaaucugcaucuga

SEQ ID NO: 156075 - RNA, 1698 nt, Artificial Sequence
  derived and/or modified sequence opt4 from hemagglutinin__InfluenzaA__ACY77743
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcuggagccugcagugcagaaucugcaucuga

SEQ ID NO: 156076 - RNA, 1701 nt, Artificial Sequence; identical to SEQ ID NO: 155189
  derived and/or modified sequence opt4 from hemagglutinin__InfluenzaA__ACY77753

SEQ ID NO: 156077 - RNA, 1695 nt, Artificial Sequence
  derived and/or modified sequence opt4 from hemagglutinin__InfluenzaA__ACY77783
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcugggcgacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcgacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagagccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccacagcugcagaaucugcaucuga

SEQ ID NO: 156078 - RNA, 1698 nt, Artificial Sequence
  derived and/or modified sequence opt4 from hemagglutinin__InfluenzaA__ACY77813
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccggccagugcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccaccugcagugcagaaucugcaucuga

SEQ ID NO: 156079 - RNA, 1698 nt, Artificial Sequence
  derived and/or modified sequence opt4 from hemagglutinin__InfluenzaA__ACY77823
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccggccagugcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcuggagccugcagugcagaaucugcaucuga

SEQ ID NO: 156080 - RNA, 1698 nt, Artificial Sequence
  derived and/or modified sequence opt4 from hemagglutinin__InfluenzaA__ACY77833
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcuggagccugcagugcagaaucugcaucuga

SEQ ID NO: 156081 - RNA, 1698 nt, Artificial Sequence
  derived and/or modified sequence opt4 from hemagglutinin__InfluenzaA__ACY77843
augaaggccauccugguggugaugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccaccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggccaccugcagugcagaaucugcaucuga

SEQ ID NO: 156082 - RNA, 1701 nt, Artificial Sequence
  derived and/or modified sequence opt4 from hemagglutinin__InfluenzaA__ACY77863
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcggcaugagccugcagugcagaaucugcaucuga

SEQ ID NO: 156083 - RNA, 1701 nt, Artificial Sequence; identical to SEQ ID NO: 155176
  derived and/or modified sequence opt4 from hemagglutinin__InfluenzaA__ACY77874

SEQ ID NO: 156084 - RNA, 1701 nt, Artificial Sequence; identical to SEQ ID NO: 155176
  derived and/or modified sequence opt4 from hemagglutinin__InfluenzaA__ACY77884

SEQ ID NO: 156085 - RNA, 1701 nt, Artificial Sequence
  derived and/or modified sequence opt4 from hemagglutinin__InfluenzaA__ACY77904
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaagcacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156086 - RNA, 1701 nt, Artificial Sequence; identical to SEQ ID NO: 155369
  derived and/or modified sequence opt4 from hemagglutinin__InfluenzaA__ACY77914

SEQ ID NO: 156087 - RNA, 1701 nt, Artificial Sequence
  derived and/or modified sequence opt4 from hemagglutinin__InfluenzaA__ACY77924
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacgacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156088 - RNA, 1701 nt, Artificial Sequence; identical to SEQ ID NO: 155937
  derived and/or modified sequence opt4 from hemagglutinin__InfluenzaA__ACY77934

SEQ ID NO: 156089 - RNA, 1701 nt, Artificial Sequence
  derived and/or modified sequence opt4 from hemagglutinin__InfluenzaA__ACY77944
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccgagagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156090 - RNA, 1701 nt, Artificial Sequence; identical to SEQ ID NO: 155176
  derived and/or modified sequence opt4 from hemagglutinin__InfluenzaA__ACY77954

SEQ ID NO: 156091 - RNA, 1701 nt, Artificial Sequence; identical to SEQ ID NO: 155176
  derived and/or modified sequence opt4 from hemagglutinin__InfluenzaA__ACY77964

SEQ ID NO: 156092 - RNA, 1701 nt, Artificial Sequence; identical to SEQ ID NO: 155176
  derived and/or modified sequence opt4 from hemagglutinin__InfluenzaA__ACY77974

SEQ ID NO: 156093 - RNA, 1701 nt, Artificial Sequence; identical to SEQ ID NO: 155176
  derived and/or modified sequence opt4 from hemagglutinin__InfluenzaA__ACY77984

SEQ ID NO: 156094 - RNA, 1701 nt, Artificial Sequence; identical to SEQ ID NO: 155176
  derived and/or modified sequence opt4 from hemagglutinin__InfluenzaA__ACY77994

SEQ ID NO: 156095 - RNA, 1701 nt, Artificial Sequence
  derived and/or modified sequence opt4 from hemagglutinin__InfluenzaA__ACY79633
augaaggagauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccagaagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156096 - RNA, 1701 nt, Artificial Sequence; identical to SEQ ID NO: 155987
  derived and/or modified sequence opt4 from hemagglutinin__InfluenzaA__ACZ01953

SEQ ID NO: 156097 - RNA, 1701 nt, Artificial Sequence
  derived and/or modified sequence opt4 from hemagglutinin__InfluenzaA__ACZ05050
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcagccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156098 - RNA, 1701 nt, Artificial Sequence
  derived and/or modified sequence opt4 from hemagglutinin__InfluenzaA__ACZ05061
auggaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccugaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156099 - RNA, 1701 nt, Artificial Sequence; identical to SEQ ID NO: 155176
  derived and/or modified sequence opt4 from hemagglutinin__InfluenzaA__ACZ05071

SEQ ID NO: 156100 - RNA, 1701 nt, Artificial Sequence; identical to SEQ ID NO: 155176
  derived and/or modified sequence opt4 from hemagglutinin__InfluenzaA__ACZ05081

SEQ ID NO: 156101 - RNA, 1701 nt, Artificial Sequence; identical to SEQ ID NO: 155176
  derived and/or modified sequence opt4 from hemagglutinin__InfluenzaA__ACZ05091

SEQ ID NO: 156102 - RNA, 1701 nt, Artificial Sequence; identical to SEQ ID NO: 155176
  derived and/or modified sequence opt4 from hemagglutinin__InfluenzaA__ACZ05101

SEQ ID NO: 156103 - RNA, 1701 nt, Artificial Sequence; identical to SEQ ID NO: 155176
  derived and/or modified sequence opt4 from hemagglutinin__InfluenzaA__ACZ05111

SEQ ID NO: 156104 - RNA, 1701 nt, Artificial Sequence
  derived and/or modified sequence opt4 from hemagglutinin__InfluenzaA__ACZ05121
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaacaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcaugggcagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156105 - RNA, 1701 nt, Artificial Sequence; identical to SEQ ID NO: 155176
  derived and/or modified sequence opt4 from hemagglutinin__InfluenzaA__ACZ05131

SEQ ID NO: 156106 - RNA, 1701 nt, Artificial Sequence; identical to SEQ ID NO: 155176
  derived and/or modified sequence opt4 from hemagglutinin__InfluenzaA__ACZ05141

SEQ ID NO: 156107 - RNA, 1701 nt, Artificial Sequence; identical to SEQ ID NO: 155176
  derived and/or modified sequence opt4 from hemagglutinin__InfluenzaA__ACZ05151

SEQ ID NO: 156108 - RNA, 1701 nt, Artificial Sequence
  derived and/or modified sequence opt4 from hemagglutinin__InfluenzaA__ACZ05172
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccaggacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 156109 - RNA, 1698 nt, Artificial Sequence; identical to SEQ ID NO: 155651
  derived and/or modified sequence opt4 from hemagglutinin__InfluenzaA__ACZ05194

SEQ ID NO: 156110 - RNA, 1701 nt, Artificial Sequence; identical to SEQ ID NO: 156108
  derived and/or modified sequence opt4 from hemagglutinin__InfluenzaA__ACZ05205

SEQ ID NO: 156111 - RNA, 1701 nt, Artificial Sequence
  derived and/or modified sequence opt4 from hemagglutinin__InfluenzaA__ACZ05216
augaagaccaucaucgcccugagcuacauccugugccugguguucgcccagaagauccccggcaacgacaacaacaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 156112 - RNA, 1701 nt, Artificial Sequence; identical to SEQ ID NO: 156108
  derived and/or modified sequence opt4 from hemagglutinin__InfluenzaA__ACZ05227

SEQ ID NO: 156113 - RNA, 1701 nt, Artificial Sequence
  derived and/or modified sequence opt4 from hemagglutinin__InfluenzaA__ACZ05238
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacugggccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 156114 - RNA, 1701 nt, Artificial Sequence; identical to SEQ ID NO: 156108
  derived and/or modified sequence opt4 from hemagglutinin__InfluenzaA__ACZ05249

SEQ ID NO: 156115 - RNA, 1701 nt, Artificial Sequence; identical to SEQ ID NO: 156108
  derived and/or modified sequence opt4 from hemagglutinin__InfluenzaA__ACZ05260

SEQ ID NO: 156116 - RNA, 1701 nt, Artificial Sequence
  derived and/or modified sequence opt4 from hemagglutinin__InfluenzaA__ACZ05271
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 156117 - RNA, 1701 nt, Artificial Sequence
  derived and/or modified sequence opt4 from hemagglutinin__InfluenzaA__ACZ05282
augaagaccaccaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 156118 - RNA, 1701 nt, Artificial Sequence; identical to SEQ ID NO: 156108
  derived and/or modified sequence opt4 from hemagglutinin__InfluenzaA__ACZ05304

SEQ ID NO: 156119 - RNA, 1701 nt, Artificial Sequence; identical to SEQ ID NO: 155931
  derived and/or modified sequence opt4 from hemagglutinin__InfluenzaA__ACZ05315

SEQ ID NO: 156120 - RNA, 1701 nt, Artificial Sequence; identical to SEQ ID NO: 156108
  derived and/or modified sequence opt4 from hemagglutinin__InfluenzaA__ACZ05326

SEQ ID NO: 156121 - RNA, 1701 nt, Artificial Sequence
  derived and/or modified sequence opt4 from hemagglutinin__InfluenzaA__ACZ05337
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagauucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucagcagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuucaaggacuggauccuguggaucagcuucgccaucagcugcuuccugcugugcguggcccugcugggcuucaucaugugggccugccagaagggcaacaucagaugcaacaucugcaucuga

SEQ ID NO: 156122 - RNA, 1701 nt, Artificial Sequence; identical to SEQ ID NO: 156108
  derived and/or modified sequence opt4 from hemagglutinin__InfluenzaA__ACZ05348

SEQ ID NO: 156123 - RNA, 1701 nt, Artificial Sequence; identical to SEQ ID NO: 156113
  derived and/or modified sequence opt4 from hemagglutinin__InfluenzaA__ACZ05359

SEQ ID NO: 156124 - RNA, 1701 nt, Artificial Sequence; identical to SEQ ID NO: 156108
  derived and/or modified sequence opt4 from hemagglutinin__InfluenzaA__ACZ05370

SEQ ID NO: 156125 - RNA, 1701 nt, Artificial Sequence
  derived and/or modified sequence opt4 from hemagglutinin__InfluenzaA__ACZ05392
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcgccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 156126 - RNA, 1701 nt, Artificial Sequence; identical to SEQ ID NO: 156108
  derived and/or modified sequence opt4 from hemagglutinin__InfluenzaA__ACZ05403

SEQ ID NO: 156127 - RNA, 1701 nt, Artificial Sequence
  derived and/or modified sequence opt4 from hemagglutinin__InfluenzaA__ACZ05436
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagagcugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 156128 - RNA, 1701 nt, Artificial Sequence; identical to SEQ ID NO: 156108
  derived and/or modified sequence opt4 from hemagglutinin__InfluenzaA__ACZ05458

SEQ ID NO: 156129 - RNA, 1701 nt, Artificial Sequence; identical to SEQ ID NO: 156108
  derived and/or modified sequence opt4 from hemagglutinin__InfluenzaA__ACZ05469

SEQ ID NO: 156130 - RNA, 1701 nt, Artificial Sequence; identical to SEQ ID NO: 156127
  derived and/or modified sequence opt4 from hemagglutinin__InfluenzaA__ACZ05480

SEQ ID NO: 156131 - RNA, 1701 nt, Artificial Sequence; identical to SEQ ID NO: 155931
  derived and/or modified sequence opt4 from hemagglutinin__InfluenzaA__ACZ05513

SEQ ID NO: 156132 - RNA, 1701 nt, Artificial Sequence; identical to SEQ ID NO: 156108
  derived and/or modified sequence opt4 from hemagglutinin__InfluenzaA__ACZ05524

SEQ ID NO: 156133 - RNA, 1701 nt, Artificial Sequence
  derived and/or modified sequence opt4 from hemagglutinin__InfluenzaA__ACZ05535
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 156134 - RNA, 1701 nt, Artificial Sequence; identical to SEQ ID NO: 156133
  derived and/or modified sequence opt4 from hemagglutinin__InfluenzaA__ACZ05546

SEQ ID NO: 156135 - RNA, 1701 nt, Artificial Sequence; identical to SEQ ID NO: 156108
  derived and/or modified sequence opt4 from hemagglutinin__InfluenzaA__ACZ05557

SEQ ID NO: 156136 - RNA, 1698 nt, Artificial Sequence
  derived and/or modified sequence opt4 from hemagglutinin__InfluenzaA__ACZ05579
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccgugaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagacccccagaggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156137 - RNA, 1698 nt, Artificial Sequence
  derived and/or modified sequence opt4 from hemagglutinin__InfluenzaA__ACZ05590
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucagcgaccagaagacccuguaccacaccgaggacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccaugggcaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156138 - RNA, 1701 nt, Artificial Sequence; identical to SEQ ID NO: 156133
  derived and/or modified sequence opt4 from hemagglutinin__InfluenzaA__ACZ05950

SEQ ID NO: 156139 - RNA, 1701 nt, Artificial Sequence; identical to SEQ ID NO: 156108
  derived and/or modified sequence opt4 from hemagglutinin__InfluenzaA__ACZ05961

SEQ ID NO: 156140 - RNA, 1701 nt, Artificial Sequence
  derived and/or modified sequence opt4 from hemagglutinin__InfluenzaA__ACZ05972
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcagccugcugugcguggcccugcugggcuucaucaugugggccugccagaagggcaacaucagaugcaacaucugcaucuga

SEQ ID NO: 156141 - RNA, 1701 nt, Artificial Sequence
  derived and/or modified sequence opt4 from hemagglutinin__InfluenzaA__ACZ05983
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaacaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 156142 - RNA, 1701 nt, Artificial Sequence
  derived and/or modified sequence opt4 from hemagglutinin__InfluenzaA__ACZ05994
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccgugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 156143 - RNA, 1701 nt, Artificial Sequence; identical to SEQ ID NO: 156108
  derived and/or modified sequence opt4 from hemagglutinin__InfluenzaA__ACZ06005

SEQ ID NO: 156144 - RNA, 1701 nt, Artificial Sequence; identical to SEQ ID NO: 156108
  derived and/or modified sequence opt4 from hemagglutinin__InfluenzaA__ACZ06016

SEQ ID NO: 156145 - RNA, 1698 nt, Artificial Sequence
  derived and/or modified sequence opt4 from hemagglutinin__InfluenzaA__ACZ16013
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaaggccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156146 - RNA, 1698 nt, Artificial Sequence
  derived and/or modified sequence opt4 from hemagglutinin__InfluenzaA__ACZ16023
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156147 - RNA, 1698 nt, Artificial Sequence
  derived and/or modified sequence opt4 from hemagglutinin__InfluenzaA__ACZ16033
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgccagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacaaggagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156148 - RNA, 1701 nt, Artificial Sequence; identical to SEQ ID NO: 155176
  derived and/or modified sequence opt4 from hemagglutinin__InfluenzaA__ACZ16040

SEQ ID NO: 156149 - RNA, 1701 nt, Artificial Sequence; identical to SEQ ID NO: 155176
  derived and/or modified sequence opt4 from hemagglutinin__InfluenzaA__ACZ16050

SEQ ID NO: 156150 - RNA, 1701 nt, Artificial Sequence; identical to SEQ ID NO: 155176
  derived and/or modified sequence opt4 from hemagglutinin__InfluenzaA__ACZ16060

SEQ ID NO: 156151 - RNA, 1701 nt, Artificial Sequence
  derived and/or modified sequence opt4 from hemagglutinin__InfluenzaA__ACZ16070
augaaggccauccugguggugcugcuguacaccuucgccaccgccaacgccgacacccugugcaucggcuaccacgccaacaacagcaccgacaccguggacaccgugcuggagaagaacgugaccgugacccacagcgugagccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156152 - RNA, 1701 nt, Artificial Sequence
  derived and/or modified sequence opt4 from hemagglutinin__InfluenzaA__ACZ16080
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgacggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156153 - RNA, 1701 nt, Artificial Sequence
  derived and/or modified sequence opt4 from hemagglutinin__InfluenzaA__ACZ16090
augaaggccauccugcuggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcaugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156154 - RNA, 1701 nt, Artificial Sequence; identical to SEQ ID NO: 155176
  derived and/or modified sequence opt4 from hemagglutinin__InfluenzaA__ACZ16100

SEQ ID NO: 156155 - RNA, 1701 nt, Artificial Sequence; identical to SEQ ID NO: 155176
  derived and/or modified sequence opt4 from hemagglutinin__InfluenzaA__ACZ16110

SEQ ID NO: 156156 - RNA, 1701 nt, Artificial Sequence; identical to SEQ ID NO: 155176
  derived and/or modified sequence opt4 from hemagglutinin__InfluenzaA__ACZ16120

SEQ ID NO: 156157 - RNA, 1701 nt, Artificial Sequence; identical to SEQ ID NO: 155924
  derived and/or modified sequence opt4 from hemagglutinin__InfluenzaA__ACZ16130

SEQ ID NO: 156158 - RNA, 1701 nt, Artificial Sequence; identical to SEQ ID NO: 155176
  derived and/or modified sequence opt4 from hemagglutinin__InfluenzaA__ACZ16140

SEQ ID NO: 156159 - RNA, 1701 nt, Artificial Sequence; identical to SEQ ID NO: 155176
  derived and/or modified sequence opt4 from hemagglutinin__InfluenzaA__ACZ16150

SEQ ID NO: 156160 - RNA, 1701 nt, Artificial Sequence; identical to SEQ ID NO: 155176
  derived and/or modified sequence opt4 from hemagglutinin__InfluenzaA__ACZ16160

SEQ ID NO: 156161 - RNA, 1701 nt, Artificial Sequence; identical to SEQ ID NO: 155369
  derived and/or modified sequence opt4 from hemagglutinin__InfluenzaA__ACZ16170

SEQ ID NO: 156162 - RNA, 1701 nt, Artificial Sequence
  derived and/or modified sequence opt4 from hemagglutinin__InfluenzaA__ACZ16180
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccuguacaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156163 - RNA, 1701 nt, Artificial Sequence; identical to SEQ ID NO: 155176
  derived and/or modified sequence opt4 from hemagglutinin__InfluenzaA__ACZ16190

SEQ ID NO: 156164 - RNA, 1701 nt, Artificial Sequence
  derived and/or modified sequence opt4 from hemagglutinin__InfluenzaA__ACZ16200
augaaggccauccugguggugcugcuguacaccuucgccaccgccaaccccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156165 - RNA, 1701 nt, Artificial Sequence; identical to SEQ ID NO: 155176
  derived and/or modified sequence opt4 from hemagglutinin__InfluenzaA__ACZ16210

SEQ ID NO: 156166 - RNA, 1701 nt, Artificial Sequence; identical to SEQ ID NO: 155176
  derived and/or modified sequence opt4 from hemagglutinin__InfluenzaA__ACZ16220

SEQ ID NO: 156167 - RNA, 1701 nt, Artificial Sequence; identical to SEQ ID NO: 155924
  derived and/or modified sequence opt4 from hemagglutinin__InfluenzaA__ACZ16230

SEQ ID NO: 156168 - RNA, 1701 nt, Artificial Sequence
  derived and/or modified sequence opt4 from hemagglutinin__InfluenzaA__ACZ16240
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgcccuggacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156169 - RNA, 1701 nt, Artificial Sequence; identical to SEQ ID NO: 155176
  derived and/or modified sequence opt4 from hemagglutinin__InfluenzaA__ACZ16260

SEQ ID NO: 156170 - RNA, 1701 nt, Artificial Sequence
  derived and/or modified sequence opt4 from hemagglutinin__InfluenzaA__ACZ16270
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagaaccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccugauccugguggugagccugggcgccaucagcuucuggaugugcagcaacggcagccugcagugcagaaucugcaucuga

SEQ ID NO: 156171 - RNA, 1701 nt, Artificial Sequence; identical to SEQ ID NO: 155851
  derived and/or modified sequence opt4 from hemagglutinin__InfluenzaA__ACZ16280

SEQ ID NO: 156172 - RNA, 1701 nt, Artificial Sequence; identical to SEQ ID NO: 155176
  derived and/or modified sequence opt4 from hemagglutinin__InfluenzaA__ACZ16290

SEQ ID NO: 156173 - RNA, 1701 nt, Artificial Sequence
  derived and/or modified sequence opt4 from hemagglutinin__InfluenzaA__ACZ16300
augaaggccauccugguggugcugcuguacaccuucgccaccgccaacgccgacacccugugcaucggcuaccacgccaacaacagcaccgacaccguggacaccgugcuggagaagaacgugaucgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156174 - RNA, 1701 nt, Artificial Sequence; identical to SEQ ID NO: 155919
  derived and/or modified sequence opt4 from hemagglutinin__InfluenzaA__ACZ16310

SEQ ID NO: 156175 - RNA, 1701 nt, Artificial Sequence
  derived and/or modified sequence opt4 from hemagglutinin__InfluenzaA__ACZ16320
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccagacugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156176 - RNA, 1701 nt, Artificial Sequence; identical to SEQ ID NO: 155919
  derived and/or modified sequence opt4 from hemagglutinin__InfluenzaA__ACZ16330

SEQ ID NO: 156177 - RNA, 1701 nt, Artificial Sequence; identical to SEQ ID NO: 155369
  derived and/or modified sequence opt4 from hemagglutinin__InfluenzaA__ACZ16340

SEQ ID NO: 156178 - RNA, 1701 nt, Artificial Sequence; identical to SEQ ID NO: 155176
  derived and/or modified sequence opt4 from hemagglutinin__InfluenzaA__ACZ16350

SEQ ID NO: 156179 - RNA, 1701 nt, Artificial Sequence; identical to SEQ ID NO: 155176
  derived and/or modified sequence opt4 from hemagglutinin__InfluenzaA__ACZ16360

SEQ ID NO: 156180 - RNA, 1701 nt, Artificial Sequence; identical to SEQ ID NO: 155369
  derived and/or modified sequence opt4 from hemagglutinin__InfluenzaA__ACZ16370

SEQ ID NO: 156181 - RNA, 1701 nt, Artificial Sequence; identical to SEQ ID NO: 155176
  derived and/or modified sequence opt4 from hemagglutinin__InfluenzaA__ACZ16380

SEQ ID NO: 156182 - RNA, 1701 nt, Artificial Sequence; identical to SEQ ID NO: 155176
  derived and/or modified sequence opt4 from hemagglutinin__InfluenzaA__ACZ16390

SEQ ID NO: 156183 - RNA, 1701 nt, Artificial Sequence; identical to SEQ ID NO: 155176
  derived and/or modified sequence opt4 from hemagglutinin__InfluenzaA__ACZ16400

SEQ ID NO: 156184 - RNA, 1701 nt, Artificial Sequence; identical to SEQ ID NO: 155176
  derived and/or modified sequence opt4 from hemagglutinin__InfluenzaA__ACZ16410

SEQ ID NO: 156185 - RNA, 1701 nt, Artificial Sequence; identical to SEQ ID NO: 155813
  derived and/or modified sequence opt4 from hemagglutinin__InfluenzaA__ACZ16420

SEQ ID NO: 156186 - RNA, 1701 nt, Artificial Sequence; identical to SEQ ID NO: 155176
  derived and/or modified sequence opt4 from hemagglutinin__InfluenzaA__ACZ16430

SEQ ID NO: 156187 - RNA, 1701 nt, Artificial Sequence; identical to SEQ ID NO: 155176
  derived and/or modified sequence opt4 from hemagglutinin__InfluenzaA__ACZ16440

SEQ ID NO: 156188 - RNA, 1701 nt, Artificial Sequence
  derived and/or modified sequence opt4 from hemagglutinin__InfluenzaA__ACZ16450
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccuggugaagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156189 - RNA, 1701 nt, Artificial Sequence; identical to SEQ ID NO: 155369
  derived and/or modified sequence opt4 from hemagglutinin__InfluenzaA__ACZ16460

SEQ ID NO: 156190 - RNA, 1701 nt, Artificial Sequence; identical to SEQ ID NO: 155176
  derived and/or modified sequence opt4 from hemagglutinin__InfluenzaA__ACZ16470

SEQ ID NO: 156191 - RNA, 1701 nt, Artificial Sequence; identical to SEQ ID NO: 155176
  derived and/or modified sequence opt4 from hemagglutinin__InfluenzaA__ACZ16480

SEQ ID NO: 156192 - RNA, 1701 nt, Artificial Sequence; identical to SEQ ID NO: 155924
  derived and/or modified sequence opt4 from hemagglutinin__InfluenzaA__ACZ16490

SEQ ID NO: 156193 - RNA, 1701 nt, Artificial Sequence; identical to SEQ ID NO: 155176
  derived and/or modified sequence opt4 from hemagglutinin__InfluenzaA__ACZ16500

SEQ ID NO: 156194 - RNA, 1701 nt, Artificial Sequence; identical to SEQ ID NO: 155369
  derived and/or modified sequence opt4 from hemagglutinin__InfluenzaA__ACZ16510

SEQ ID NO: 156195 - RNA, 1701 nt, Artificial Sequence; identical to SEQ ID NO: 155176
  derived and/or modified sequence opt4 from hemagglutinin__InfluenzaA__ACZ16530

SEQ ID NO: 156196 - RNA, 1701 nt, Artificial Sequence
  derived and/or modified sequence opt4 from hemagglutinin__InfluenzaA__ACZ16540
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccugcugggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156197 - RNA, 1701 nt, Artificial Sequence; identical to SEQ ID NO: 155919
  derived and/or modified sequence opt4 from hemagglutinin__InfluenzaA__ACZ16550

SEQ ID NO: 156198 - RNA, 1701 nt, Artificial Sequence; identical to SEQ ID NO: 155176
  derived and/or modified sequence opt4 from hemagglutinin__InfluenzaA__ACZ16583

SEQ ID NO: 156199 - RNA, 1701 nt, Artificial Sequence; identical to SEQ ID NO: 155919
  derived and/or modified sequence opt4 from hemagglutinin__InfluenzaA__ACZ16593

SEQ ID NO: 156200 - RNA, 1701 nt, Artificial Sequence; identical to SEQ ID NO: 155176
  derived and/or modified sequence opt4 from hemagglutinin__InfluenzaA__ACZ16603

SEQ ID NO: 156201 - RNA, 1701 nt, Artificial Sequence; identical to SEQ ID NO: 155919
  derived and/or modified sequence opt4 from hemagglutinin__InfluenzaA__ACZ16630

SEQ ID NO: 156202 - RNA, 1701 nt, Artificial Sequence; identical to SEQ ID NO: 155176
  derived and/or modified sequence opt4 from hemagglutinin__InfluenzaA__ACZ16640

SEQ ID NO: 156203 - RNA, 1701 nt, Artificial Sequence; identical to SEQ ID NO: 155176
  derived and/or modified sequence opt4 from hemagglutinin__InfluenzaA__ACZ16650

SEQ ID NO: 156204 - RNA, 1701 nt, Artificial Sequence; identical to SEQ ID NO: 155176
  derived and/or modified sequence opt4 from hemagglutinin__InfluenzaA__ACZ16660

SEQ ID NO: 156205 - RNA, 1701 nt, Artificial Sequence; identical to SEQ ID NO: 155176
  derived and/or modified sequence opt4 from hemagglutinin__InfluenzaA__ACZ16670

SEQ ID NO: 156206 - RNA, 1701 nt, Artificial Sequence; identical to SEQ ID NO: 155176
  derived and/or modified sequence opt4 from hemagglutinin__InfluenzaA__ACZ16680

SEQ ID NO: 156207 - RNA, 1701 nt, Artificial Sequence; identical to SEQ ID NO: 155176
  derived and/or modified sequence opt4 from hemagglutinin__InfluenzaA__ACZ16690

SEQ ID NO: 156208 - RNA, 1701 nt, Artificial Sequence; identical to SEQ ID NO: 155176
  derived and/or modified sequence opt4 from hemagglutinin__InfluenzaA__ACZ16700

SEQ ID NO: 156209 - RNA, 1701 nt, Artificial Sequence; identical to SEQ ID NO: 155176
  derived and/or modified sequence opt4 from hemagglutinin__InfluenzaA__ACZ16710

SEQ ID NO: 156210 - RNA, 1701 nt, Artificial Sequence; identical to SEQ ID NO: 155176
  derived and/or modified sequence opt4 from hemagglutinin__InfluenzaA__ACZ16720

SEQ ID NO: 156211 - RNA, 1701 nt, Artificial Sequence; identical to SEQ ID NO: 155919
  derived and/or modified sequence opt4 from hemagglutinin__InfluenzaA__ACZ16730

SEQ ID NO: 156212 - RNA, 1701 nt, Artificial Sequence; identical to SEQ ID NO: 155919
  derived and/or modified sequence opt4 from hemagglutinin__InfluenzaA__ACZ16740

SEQ ID NO: 156213 - RNA, 1701 nt, Artificial Sequence; identical to SEQ ID NO: 155176
  derived and/or modified sequence opt4 from hemagglutinin__InfluenzaA__ACZ16750

SEQ ID NO: 156214 - RNA, 1701 nt, Artificial Sequence; identical to SEQ ID NO: 155176
  derived and/or modified sequence opt4 from hemagglutinin__InfluenzaA__ACZ16760

SEQ ID NO: 156215 - RNA, 1701 nt, Artificial Sequence; identical to SEQ ID NO: 155369
  derived and/or modified sequence opt4 from hemagglutinin__InfluenzaA__ACZ16770

SEQ ID NO: 156216 - RNA, 1701 nt, Artificial Sequence; identical to SEQ ID NO: 155176
  derived and/or modified sequence opt4 from hemagglutinin__InfluenzaA__ACZ16780

SEQ ID NO: 156217 - RNA, 1701 nt, Artificial Sequence; identical to SEQ ID NO: 155176
  derived and/or modified sequence opt4 from hemagglutinin__InfluenzaA__ACZ16790

SEQ ID NO: 156218 - RNA, 1701 nt, Artificial Sequence; identical to SEQ ID NO: 155176
  derived and/or modified sequence opt4 from hemagglutinin__InfluenzaA__ACZ16800

SEQ ID NO: 156219 - RNA, 1701 nt, Artificial Sequence; identical to SEQ ID NO: 155176
  derived and/or modified sequence opt4 from hemagglutinin__InfluenzaA__ACZ16810

SEQ ID NO: 156220 - RNA, 1701 nt, Artificial Sequence; identical to SEQ ID NO: 155851
  derived and/or modified sequence opt4 from hemagglutinin__InfluenzaA__ACZ16820

SEQ ID NO: 156221 - RNA, 1701 nt, Artificial Sequence; identical to SEQ ID NO: 155176
  derived and/or modified sequence opt4 from hemagglutinin__InfluenzaA__ACZ16830

SEQ ID NO: 156222 - RNA, 1701 nt, Artificial Sequence
  derived and/or modified sequence opt4 from hemagglutinin__InfluenzaA__ACZ16840
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagaaccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156223 - RNA, 1701 nt, Artificial Sequence; identical to SEQ ID NO: 155176
  derived and/or modified sequence opt4 from hemagglutinin__InfluenzaA__ACZ16850

SEQ ID NO: 156224 - RNA, 1701 nt, Artificial Sequence
  derived and/or modified sequence opt4 from hemagglutinin__InfluenzaA__ACZ16860
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggcccccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156225 - RNA, 1701 nt, Artificial Sequence; identical to SEQ ID NO: 155919
  derived and/or modified sequence opt4 from hemagglutinin__InfluenzaA__ACZ16870

SEQ ID NO: 156226 - RNA, 1701 nt, Artificial Sequence
  derived and/or modified sequence opt4 from hemagglutinin__InfluenzaA__ACZ16880
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgacggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcaacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156227 - RNA, 1701 nt, Artificial Sequence; identical to SEQ ID NO: 155924
  derived and/or modified sequence opt4 from hemagglutinin__InfluenzaA__ACZ16890

SEQ ID NO: 156228 - RNA, 1701 nt, Artificial Sequence; identical to SEQ ID NO: 155176
  derived and/or modified sequence opt4 from hemagglutinin__InfluenzaA__ACZ16900

SEQ ID NO: 156229 - RNA, 1701 nt, Artificial Sequence; identical to SEQ ID NO: 155176
  derived and/or modified sequence opt4 from hemagglutinin__InfluenzaA__ACZ16910

SEQ ID NO: 156230 - RNA, 1701 nt, Artificial Sequence; identical to SEQ ID NO: 155176
  derived and/or modified sequence opt4 from hemagglutinin__InfluenzaA__ACZ16920

SEQ ID NO: 156231 - RNA, 1701 nt, Artificial Sequence; identical to SEQ ID NO: 155189
  derived and/or modified sequence opt4 from hemagglutinin__InfluenzaA__ACZ16930

SEQ ID NO: 156232 - RNA, 1701 nt, Artificial Sequence; identical to SEQ ID NO: 155189
  derived and/or modified sequence opt4 from hemagglutinin__InfluenzaA__ACZ16940

SEQ ID NO: 156233 - RNA, 1701 nt, Artificial Sequence; identical to SEQ ID NO: 155176
  derived and/or modified sequence opt4 from hemagglutinin__InfluenzaA__ACZ16950

SEQ ID NO: 156234 - RNA, 1701 nt, Artificial Sequence; identical to SEQ ID NO: 155431
  derived and/or modified sequence opt4 from hemagglutinin__InfluenzaA__ACZ16960

SEQ ID NO: 156235 - RNA, 1701 nt, Artificial Sequence
  derived and/or modified sequence opt4 from hemagglutinin__InfluenzaA__ACZ16970
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaaggagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156236 - RNA, 1701 nt, Artificial Sequence; identical to SEQ ID NO: 155189
  derived and/or modified sequence opt4 from hemagglutinin__InfluenzaA__ACZ16980

SEQ ID NO: 156237 - RNA, 1701 nt, Artificial Sequence; identical to SEQ ID NO: 155189
  derived and/or modified sequence opt4 from hemagglutinin__InfluenzaA__ACZ17000

SEQ ID NO: 156238 - RNA, 1701 nt, Artificial Sequence
  derived and/or modified sequence opt4 from hemagglutinin__InfluenzaA__ACZ17010
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156239 - RNA, 1701 nt, Artificial Sequence; identical to SEQ ID NO: 155189
  derived and/or modified sequence opt4 from hemagglutinin__InfluenzaA__ACZ17020

SEQ ID NO: 156240 - RNA, 1701 nt, Artificial Sequence
  derived and/or modified sequence opt4 from hemagglutinin__InfluenzaA__ACZ17030
augaaggccacccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggaggccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156241 - RNA, 1701 nt, Artificial Sequence
  derived and/or modified sequence opt4 from hemagglutinin__InfluenzaA__ACZ17040
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcaaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156242 - RNA, 1701 nt, Artificial Sequence; identical to SEQ ID NO: 155189
  derived and/or modified sequence opt4 from hemagglutinin__InfluenzaA__ACZ17050

SEQ ID NO: 156243 - RNA, 1701 nt, Artificial Sequence; identical to SEQ ID NO: 155189
  derived and/or modified sequence opt4 from hemagglutinin__InfluenzaA__ACZ17060

SEQ ID NO: 156244 - RNA, 1701 nt, Artificial Sequence; identical to SEQ ID NO: 155189
  derived and/or modified sequence opt4 from hemagglutinin__InfluenzaA__ACZ17070

SEQ ID NO: 156245 - RNA, 1701 nt, Artificial Sequence; identical to SEQ ID NO: 155369
  derived and/or modified sequence opt4 from hemagglutinin__InfluenzaA__ACZ17080

SEQ ID NO: 156246 - RNA, 1701 nt, Artificial Sequence
  derived and/or modified sequence opt4 from hemagglutinin__InfluenzaA__ACZ17090
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcugggcgacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugaagagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156247 - RNA, 1701 nt, Artificial Sequence; identical to SEQ ID NO: 155176
  derived and/or modified sequence opt4 from hemagglutinin__InfluenzaA__ACZ17100

SEQ ID NO: 156248 - RNA, 1701 nt, Artificial Sequence
  derived and/or modified sequence opt4 from hemagglutinin__InfluenzaA__ACZ17110
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccgagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156249 - RNA, 1701 nt, Artificial Sequence
  derived and/or modified sequence opt4 from hemagglutinin__InfluenzaA__ACZ17120
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaccaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156250 - RNA, 1701 nt, Artificial Sequence
  derived and/or modified sequence opt4 from hemagglutinin__InfluenzaA__ACZ17130
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacgcccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156251 - RNA, 1701 nt, Artificial Sequence; identical to SEQ ID NO: 155987
  derived and/or modified sequence opt4 from hemagglutinin__InfluenzaA__ACZ17140

SEQ ID NO: 156252 - RNA, 1701 nt, Artificial Sequence; identical to SEQ ID NO: 155818
  derived and/or modified sequence opt4 from hemagglutinin__InfluenzaA__ACZ17150

SEQ ID NO: 156253 - RNA, 1701 nt, Artificial Sequence; identical to SEQ ID NO: 155818
  derived and/or modified sequence opt4 from hemagglutinin__InfluenzaA__ACZ17160

SEQ ID NO: 156254 - RNA, 1701 nt, Artificial Sequence; identical to SEQ ID NO: 155818
  derived and/or modified sequence opt4 from hemagglutinin__InfluenzaA__ACZ17170

SEQ ID NO: 156255 - RNA, 1701 nt, Artificial Sequence
  derived and/or modified sequence opt4 from hemagglutinin__InfluenzaA__ACZ17190
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcagcaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156256 - RNA, 1701 nt, Artificial Sequence; identical to SEQ ID NO: 156255
  derived and/or modified sequence opt4 from hemagglutinin__InfluenzaA__ACZ17200

SEQ ID NO: 156257 - RNA, 1701 nt, Artificial Sequence; identical to SEQ ID NO: 155189
  derived and/or modified sequence opt4 from hemagglutinin__InfluenzaA__ACZ17220

SEQ ID NO: 156258 - RNA, 1701 nt, Artificial Sequence
  derived and/or modified sequence opt4 from hemagglutinin__InfluenzaA__ACZ17230
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugaaggagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156259 - RNA, 1701 nt, Artificial Sequence; identical to SEQ ID NO: 155189
  derived and/or modified sequence opt4 from hemagglutinin__InfluenzaA__ACZ17240

SEQ ID NO: 156260 - RNA, 1701 nt, Artificial Sequence; identical to SEQ ID NO: 155189
  derived and/or modified sequence opt4 from hemagglutinin__InfluenzaA__ACZ17250

SEQ ID NO: 156261 - RNA, 1701 nt, Artificial Sequence; identical to SEQ ID NO: 155189
  derived and/or modified sequence opt4 from hemagglutinin__InfluenzaA__ACZ17260

SEQ ID NO: 156262 - RNA, 1701 nt, Artificial Sequence
  derived and/or modified sequence opt4 from hemagglutinin__InfluenzaA__ACZ17270
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcagaugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaagcuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaguguaccagauccuggccaucuacagcaccguggccagcagccuggugcugguggugagccugggcgccaucagcuucuggaugugcagcaacggcagccugcagugcagaaucugcaucuga

SEQ ID NO: 156263 - RNA, 1701 nt, Artificial Sequence; identical to SEQ ID NO: 155369
  derived and/or modified sequence opt4 from hemagglutinin__InfluenzaA__ACZ17290

SEQ ID NO: 156264 - RNA, 1701 nt, Artificial Sequence; identical to SEQ ID NO: 155369
  derived and/or modified sequence opt4 from hemagglutinin__InfluenzaA__ACZ17300

SEQ ID NO: 156265 - RNA, 1701 nt, Artificial Sequence; identical to SEQ ID NO: 155369
  derived and/or modified sequence opt4 from hemagglutinin__InfluenzaA__ACZ17310

SEQ ID NO: 156266 - RNA, 1701 nt, Artificial Sequence; identical to SEQ ID NO: 155189
  derived and/or modified sequence opt4 from hemagglutinin__InfluenzaA__ACZ17398

SEQ ID NO: 156267 - RNA, 1701 nt, Artificial Sequence; identical to SEQ ID NO: 155189
  derived and/or modified sequence opt4 from hemagglutinin__InfluenzaA__ACZ17408

SEQ ID NO: 156268 - RNA, 1701 nt, Artificial Sequence; identical to SEQ ID NO: 155189
  derived and/or modified sequence opt4 from hemagglutinin__InfluenzaA__ACZ17418

SEQ ID NO: 156269 - RNA, 1701 nt, Artificial Sequence
  derived and/or modified sequence opt4 from hemagglutinin__InfluenzaA__ACZ17438
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacagcuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156270 - RNA, 1701 nt, Artificial Sequence; identical to SEQ ID NO: 155176
  derived and/or modified sequence opt4 from hemagglutinin__InfluenzaA__ACZ17448

SEQ ID NO: 156271 - RNA, 1701 nt, Artificial Sequence; identical to SEQ ID NO: 155189
  derived and/or modified sequence opt4 from hemagglutinin__InfluenzaA__ACZ17458

SEQ ID NO: 156272 - RNA, 1701 nt, Artificial Sequence; identical to SEQ ID NO: 155176
  derived and/or modified sequence opt4 from hemagglutinin__InfluenzaA__ACZ17478

SEQ ID NO: 156273 - RNA, 1701 nt, Artificial Sequence; identical to SEQ ID NO: 155189
  derived and/or modified sequence opt4 from hemagglutinin__InfluenzaA__ACZ17488

SEQ ID NO: 156274 - RNA, 1701 nt, Artificial Sequence
  derived and/or modified sequence opt4 from hemagglutinin__InfluenzaA__ACZ18240
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccaccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156275 - RNA, 1701 nt, Artificial Sequence; identical to SEQ ID NO: 155189
  derived and/or modified sequence opt4 from hemagglutinin__InfluenzaA__ACZ18241

SEQ ID NO: 156276 - RNA, 1701 nt, Artificial Sequence
  derived and/or modified sequence opt4 from hemagglutinin__InfluenzaA__ACZ27800
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaaggaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156277 - RNA, 1701 nt, Artificial Sequence; identical to SEQ ID NO: 155189
  derived and/or modified sequence opt4 from hemagglutinin__InfluenzaA__ACZ27810

SEQ ID NO: 156278 - RNA, 1701 nt, Artificial Sequence; identical to SEQ ID NO: 155189
  derived and/or modified sequence opt4 from hemagglutinin__InfluenzaA__ACZ27820

SEQ ID NO: 156279 - RNA, 1701 nt, Artificial Sequence; identical to SEQ ID NO: 155189
  derived and/or modified sequence opt4 from hemagglutinin__InfluenzaA__ACZ27830

SEQ ID NO: 156280 - RNA, 1701 nt, Artificial Sequence; identical to SEQ ID NO: 155542
  derived and/or modified sequence opt4 from hemagglutinin__InfluenzaA__ACZ27840

SEQ ID NO: 156281 - RNA, 1701 nt, Artificial Sequence; identical to SEQ ID NO: 155176
  derived and/or modified sequence opt4 from hemagglutinin__InfluenzaA__ACZ45006

SEQ ID NO: 156282 - RNA, 1701 nt, Artificial Sequence
  derived and/or modified sequence opt4 from hemagglutinin__InfluenzaA__ACZ45007
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcgacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156283 - RNA, 1701 nt, Artificial Sequence; identical to SEQ ID NO: 155542
  derived and/or modified sequence opt4 from hemagglutinin__InfluenzaA__ACZ45008

SEQ ID NO: 156284 - RNA, 1701 nt, Artificial Sequence; identical to SEQ ID NO: 155542
  derived and/or modified sequence opt4 from hemagglutinin__InfluenzaA__ACZ45009

SEQ ID NO: 156285 - RNA, 1701 nt, Artificial Sequence; identical to SEQ ID NO: 155431
  derived and/or modified sequence opt4 from hemagglutinin__InfluenzaA__ACZ45010

SEQ ID NO: 156286 - RNA, 1701 nt, Artificial Sequence; identical to SEQ ID NO: 155189
  derived and/or modified sequence opt4 from hemagglutinin__InfluenzaA__ACZ45012

SEQ ID NO: 156287 - RNA, 1701 nt, Artificial Sequence
  derived and/or modified sequence opt4 from hemagglutinin__InfluenzaA__ACZ45013
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcagcaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156288 - RNA, 1701 nt, Artificial Sequence; identical to SEQ ID NO: 155189
  derived and/or modified sequence opt4 from hemagglutinin__InfluenzaA__ACZ45014

SEQ ID NO: 156289 - RNA, 1701 nt, Artificial Sequence; identical to SEQ ID NO: 155189
  derived and/or modified sequence opt4 from hemagglutinin__InfluenzaA__ACZ45016

SEQ ID NO: 156290 - RNA, 1701 nt, Artificial Sequence
  derived and/or modified sequence opt4 from hemagglutinin__InfluenzaA__ACZ45028
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156291 - RNA, 1701 nt, Artificial Sequence
  derived and/or modified sequence opt4 from hemagglutinin__InfluenzaA__ACZ45029
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156292 - RNA, 1701 nt, Artificial Sequence
  derived and/or modified sequence opt4 from hemagglutinin__InfluenzaA__ACZ45030
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaccuacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156293 - RNA, 1701 nt, Artificial Sequence
  derived and/or modified sequence opt4 from hemagglutinin__InfluenzaA__ACZ45031
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucaccauggagagaaacgugggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156294 - RNA, 1701 nt, Artificial Sequence
  derived and/or modified sequence opt4 from hemagglutinin__InfluenzaA__ACZ45034
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugccccccauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156295 - RNA, 1701 nt, Artificial Sequence; identical to SEQ ID NO: 155189
  derived and/or modified sequence opt4 from hemagglutinin__InfluenzaA__ACZ45036

SEQ ID NO: 156296 - RNA, 1701 nt, Artificial Sequence; identical to SEQ ID NO: 155189
  derived and/or modified sequence opt4 from hemagglutinin__InfluenzaA__ACZ45037

SEQ ID NO: 156297 - RNA, 1701 nt, Artificial Sequence; identical to SEQ ID NO: 156290
  derived and/or modified sequence opt4 from hemagglutinin__InfluenzaA__ACZ45038

SEQ ID NO: 156298 - RNA, 1701 nt, Artificial Sequence; identical to SEQ ID NO: 155542
  derived and/or modified sequence opt4 from hemagglutinin__InfluenzaA__ACZ45039

SEQ ID NO: 156299 - RNA, 1701 nt, Artificial Sequence; identical to SEQ ID NO: 155189
  derived and/or modified sequence opt4 from hemagglutinin__InfluenzaA__ACZ45040

SEQ ID NO: 156300 - RNA, 1701 nt, Artificial Sequence; identical to SEQ ID NO: 155189
  derived and/or modified sequence opt4 from hemagglutinin__InfluenzaA__ACZ52567

SEQ ID NO: 156301 - RNA, 1701 nt, Artificial Sequence; identical to SEQ ID NO: 155189
  derived and/or modified sequence opt4 from hemagglutinin__InfluenzaA__ACZ52568

SEQ ID NO: 156302 - RNA, 1701 nt, Artificial Sequence; identical to SEQ ID NO: 155758
  derived and/or modified sequence opt4 from hemagglutinin__InfluenzaA__ACZ52569

SEQ ID NO: 156303 - RNA, 1701 nt, Artificial Sequence
  derived and/or modified sequence opt4 from hemagglutinin__InfluenzaA__ACZ53956
augaagaccaucaucgcccugagcuacaucuucugccuggcccuggcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcacccugaacuggcugcaccagcugcagaacagauaccccgcccugaacgugaccaugcccaacaacgacaaguucgacaagcuguacaucuggggcgugcaccaccccagcaccgacagcgaccagaucagcguguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 156304 - RNA, 1701 nt, Artificial Sequence
  derived and/or modified sequence opt4 from hemagglutinin__InfluenzaA__ACZ53967
augaagaccaucaucgcccugagcuacaucuucugccuggcccuggcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcacccugaacuggcugcaccagcugcagaacagauaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacgugcuggugaucaacagcaacggcaaccugaucgcccccagaggcuacuucaagaugagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacaagcugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcagcaucaugugggccugccagagaggcaacaucagaugcaacaucugcaucuga

SEQ ID NO: 156305 - RNA, 1701 nt, Artificial Sequence
  derived and/or modified sequence opt4 from hemagglutinin__InfluenzaA__ACZ53978
augaagaccaucaucgcccugagcuacaucuucugccuggcccuggcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugaagagccugaucgccagcagcggcacccuggaguucaacaacgagagcuucaacuggaucggcgugagccagaacggcaccagcagcgccugcaagagaaucagcaucaccgugagcuucaacaagcugaacuggcugcaccagcugaaguacagauaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacgugcuggugaucaacagcaacggcaaccugaucgcccccagaggcuacuucaagaugagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaccggcaagcugaacaagcugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 156306 - RNA, 1701 nt, Artificial Sequence
  derived and/or modified sequence opt4 from hemagglutinin__InfluenzaA__ACZ56080
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcagccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156307 - RNA, 1701 nt, Artificial Sequence
  derived and/or modified sequence opt4 from hemagglutinin__InfluenzaA__ACZ61118
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccagagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156308 - RNA, 1701 nt, Artificial Sequence
  derived and/or modified sequence opt4 from hemagglutinin__InfluenzaA__ACZ61119
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcugauccugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156309 - RNA, 1701 nt, Artificial Sequence; identical to SEQ ID NO: 155189
  derived and/or modified sequence opt4 from hemagglutinin__InfluenzaA__ACZ61122

SEQ ID NO: 156310 - RNA, 1701 nt, Artificial Sequence; identical to SEQ ID NO: 155189
  derived and/or modified sequence opt4 from hemagglutinin__InfluenzaA__ACZ61123

SEQ ID NO: 156311 - RNA, 1701 nt, Artificial Sequence; identical to SEQ ID NO: 155987
  derived and/or modified sequence opt4 from hemagglutinin__InfluenzaA__ACZ74627

SEQ ID NO: 156312 - RNA, 1698 nt, Artificial Sequence
  derived and/or modified sequence opt4 from hemagglutinin__InfluenzaA__ACZ81554
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacaaccacaacggcaagcugugccugcugaagggcaucgccccccugcagcugggcaacugcaccguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaagaucagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156313 - RNA, 1698 nt, Artificial Sequence
  derived and/or modified sequence opt4 from hemagglutinin__InfluenzaA__ACZ81555
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaagacccuguaccacaccgagaacgccuacgugagcguggugagcagccacuacagcagaaaguucacccccgagaucgccaagagacccaaggugagagaccaggagggcagaaucaacuacuacugggcccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156314 - RNA, 1698 nt, Artificial Sequence
  derived and/or modified sequence opt4 from hemagglutinin__InfluenzaA__ACZ81556
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgccagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacaaggagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156315 - RNA, 1701 nt, Artificial Sequence
  derived and/or modified sequence opt4 from hemagglutinin__InfluenzaA__ACZ81557
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcggcagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccaggcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 156316 - RNA, 1701 nt, Artificial Sequence
  derived and/or modified sequence opt4 from hemagglutinin__InfluenzaA__ACZ81558
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccacugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 156317 - RNA, 1701 nt, Artificial Sequence
  derived and/or modified sequence opt4 from hemagglutinin__InfluenzaA__ACZ81559
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccacugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 156318 - RNA, 1701 nt, Artificial Sequence; identical to SEQ ID NO: 155189
  derived and/or modified sequence opt4 from hemagglutinin__InfluenzaA__ACZ81632

SEQ ID NO: 156319 - RNA, 1701 nt, Artificial Sequence; identical to SEQ ID NO: 155189
  derived and/or modified sequence opt4 from hemagglutinin__InfluenzaA__ACZ81642

SEQ ID NO: 156320 - RNA, 1701 nt, Artificial Sequence
  derived and/or modified sequence opt4 from hemagglutinin__InfluenzaA__ACZ81652
augaaggccauccugguggugcugcuguacaccuucgccaccgccaacgccgacacccugugcaucggcuaccacgccaacaacagcaccgacaccguggacaccgugcuggagagaaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccgaggccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156321 - RNA, 1701 nt, Artificial Sequence
  derived and/or modified sequence opt4 from hemagglutinin__InfluenzaA__ACZ92130
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcaucgagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156322 - RNA, 1701 nt, Artificial Sequence; identical to SEQ ID NO: 155431
  derived and/or modified sequence opt4 from hemagglutinin__InfluenzaA__ACZ92131

SEQ ID NO: 156323 - RNA, 1701 nt, Artificial Sequence; identical to SEQ ID NO: 155431
  derived and/or modified sequence opt4 from hemagglutinin__InfluenzaA__ACZ92132

SEQ ID NO: 156324 - RNA, 1701 nt, Artificial Sequence; identical to SEQ ID NO: 155431
  derived and/or modified sequence opt4 from hemagglutinin__InfluenzaA__ACZ92133

SEQ ID NO: 156325 - RNA, 1701 nt, Artificial Sequence; identical to SEQ ID NO: 155189
  derived and/or modified sequence opt4 from hemagglutinin__InfluenzaA__ACZ92134

SEQ ID NO: 156326 - RNA, 1701 nt, Artificial Sequence; identical to SEQ ID NO: 155189
  derived and/or modified sequence opt4 from hemagglutinin__InfluenzaA__ACZ95465

SEQ ID NO: 156327 - RNA, 1701 nt, Artificial Sequence; identical to SEQ ID NO: 155176
  derived and/or modified sequence opt4 from hemagglutinin__InfluenzaA__ACZ95837

SEQ ID NO: 156328 - RNA, 1701 nt, Artificial Sequence; identical to SEQ ID NO: 155189
  derived and/or modified sequence opt4 from hemagglutinin__InfluenzaA__ACZ95847

SEQ ID NO: 156329 - RNA, 1701 nt, Artificial Sequence
  derived and/or modified sequence opt4 from hemagglutinin__InfluenzaA__ACZ95857
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagaccagcaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156330 - RNA, 1701 nt, Artificial Sequence; identical to SEQ ID NO: 155189
  derived and/or modified sequence opt4 from hemagglutinin__InfluenzaA__ACZ95867

SEQ ID NO: 156331 - RNA, 1701 nt, Artificial Sequence
  derived and/or modified sequence opt4 from hemagglutinin__InfluenzaA__ACZ95887
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagaaaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156332 - RNA, 1701 nt, Artificial Sequence; identical to SEQ ID NO: 155189
  derived and/or modified sequence opt4 from hemagglutinin__InfluenzaA__ACZ95897

SEQ ID NO: 156333 - RNA, 1701 nt, Artificial Sequence
  derived and/or modified sequence opt4 from hemagglutinin__InfluenzaA__ACZ95907
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccguguacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156334 - RNA, 1701 nt, Artificial Sequence; identical to SEQ ID NO: 155189
  derived and/or modified sequence opt4 from hemagglutinin__InfluenzaA__ACZ95927

SEQ ID NO: 156335 - RNA, 1701 nt, Artificial Sequence
  derived and/or modified sequence opt4 from hemagglutinin__InfluenzaA__ACZ95937
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaacgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156336 - RNA, 1701 nt, Artificial Sequence; identical to SEQ ID NO: 155431
  derived and/or modified sequence opt4 from hemagglutinin__InfluenzaA__ACZ95947

SEQ ID NO: 156337 - RNA, 1701 nt, Artificial Sequence; identical to SEQ ID NO: 155189
  derived and/or modified sequence opt4 from hemagglutinin__InfluenzaA__ACZ95957

SEQ ID NO: 156338 - RNA, 1701 nt, Artificial Sequence; identical to SEQ ID NO: 155431
  derived and/or modified sequence opt4 from hemagglutinin__InfluenzaA__ACZ95967

SEQ ID NO: 156339 - RNA, 1701 nt, Artificial Sequence; identical to SEQ ID NO: 156335
  derived and/or modified sequence opt4 from hemagglutinin__InfluenzaA__ACZ95977

SEQ ID NO: 156340 - RNA, 1701 nt, Artificial Sequence
  derived and/or modified sequence opt4 from hemagglutinin__InfluenzaA__ACZ95987
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156341 - RNA, 1701 nt, Artificial Sequence; identical to SEQ ID NO: 155189
  derived and/or modified sequence opt4 from hemagglutinin__InfluenzaA__ACZ95997

SEQ ID NO: 156342 - RNA, 1701 nt, Artificial Sequence; identical to SEQ ID NO: 155189
  derived and/or modified sequence opt4 from hemagglutinin__InfluenzaA__ACZ96007

SEQ ID NO: 156343 - RNA, 1701 nt, Artificial Sequence; identical to SEQ ID NO: 155176
  derived and/or modified sequence opt4 from hemagglutinin__InfluenzaA__ACZ96017

SEQ ID NO: 156344 - RNA, 1701 nt, Artificial Sequence; identical to SEQ ID NO: 155189
  derived and/or modified sequence opt4 from hemagglutinin__InfluenzaA__ACZ96027

SEQ ID NO: 156345 - RNA, 1701 nt, Artificial Sequence; identical to SEQ ID NO: 156335
  derived and/or modified sequence opt4 from hemagglutinin__InfluenzaA__ACZ96047

SEQ ID NO: 156346 - RNA, 1701 nt, Artificial Sequence
  derived and/or modified sequence opt4 from hemagglutinin__InfluenzaA__ACZ96057
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugccugcacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156347 - RNA, 1701 nt, Artificial Sequence
  derived and/or modified sequence opt4 from hemagglutinin__InfluenzaA__ACZ96069
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcaacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156348 - RNA, 1701 nt, Artificial Sequence; identical to SEQ ID NO: 156335
  derived and/or modified sequence opt4 from hemagglutinin__InfluenzaA__ACZ96089

SEQ ID NO: 156349 - RNA, 1701 nt, Artificial Sequence
  derived and/or modified sequence opt4 from hemagglutinin__InfluenzaA__ACZ96119
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156350 - RNA, 1701 nt, Artificial Sequence
  derived and/or modified sequence opt4 from hemagglutinin__InfluenzaA__ACZ96129
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgaguucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156351 - RNA, 1701 nt, Artificial Sequence; identical to SEQ ID NO: 155189
  derived and/or modified sequence opt4 from hemagglutinin__InfluenzaA__ACZ96149

SEQ ID NO: 156352 - RNA, 1701 nt, Artificial Sequence; identical to SEQ ID NO: 155189
  derived and/or modified sequence opt4 from hemagglutinin__InfluenzaA__ACZ96159

SEQ ID NO: 156353 - RNA, 1701 nt, Artificial Sequence
  derived and/or modified sequence opt4 from hemagglutinin__InfluenzaA__ACZ96179
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156354 - RNA, 1701 nt, Artificial Sequence; identical to SEQ ID NO: 156346
  derived and/or modified sequence opt4 from hemagglutinin__InfluenzaA__ACZ96189

SEQ ID NO: 156355 - RNA, 1701 nt, Artificial Sequence; identical to SEQ ID NO: 156353
  derived and/or modified sequence opt4 from hemagglutinin__InfluenzaA__ACZ96199

SEQ ID NO: 156356 - RNA, 1701 nt, Artificial Sequence; identical to SEQ ID NO: 155189
  derived and/or modified sequence opt4 from hemagglutinin__InfluenzaA__ACZ96209

SEQ ID NO: 156357 - RNA, 1701 nt, Artificial Sequence
  derived and/or modified sequence opt4 from hemagglutinin__InfluenzaA__ACZ96219
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaaguucgaggccaccggcaaccugguggugcccagauacgccuucgccauggagagaaacgccggcagcggcaucaucaucagcgacacccccgugcacgacugcaacaccaccugccagaccagcaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgccggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156358 - RNA, 1701 nt, Artificial Sequence; identical to SEQ ID NO: 155189
  derived and/or modified sequence opt4 from hemagglutinin__InfluenzaA__ACZ96229

SEQ ID NO: 156359 - RNA, 1701 nt, Artificial Sequence; identical to SEQ ID NO: 156353
  derived and/or modified sequence opt4 from hemagglutinin__InfluenzaA__ACZ96239

SEQ ID NO: 156360 - RNA, 1701 nt, Artificial Sequence; identical to SEQ ID NO: 155189
  derived and/or modified sequence opt4 from hemagglutinin__InfluenzaA__ACZ96249

SEQ ID NO: 156361 - RNA, 1701 nt, Artificial Sequence
  derived and/or modified sequence opt4 from hemagglutinin__InfluenzaA__ACZ96269
augaaggccauccugguggugcugcuguacaccuucgccaccgccaacgccgacacccugugcaucggcuaccacgccaacaacagcaccgacaccguggacaccgugcuggagagaaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156362 - RNA, 1701 nt, Artificial Sequence; identical to SEQ ID NO: 155189
  derived and/or modified sequence opt4 from hemagglutinin__InfluenzaA__ACZ96299

SEQ ID NO: 156363 - RNA, 1701 nt, Artificial Sequence; identical to SEQ ID NO: 155189
  derived and/or modified sequence opt4 from hemagglutinin__InfluenzaA__ACZ96309

SEQ ID NO: 156364 - RNA, 1701 nt, Artificial Sequence
  derived and/or modified sequence opt4 from hemagglutinin__InfluenzaA__ACZ96319
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaucugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156365 - RNA, 1701 nt, Artificial Sequence; identical to SEQ ID NO: 156364
  derived and/or modified sequence opt4 from hemagglutinin__InfluenzaA__ACZ96329

SEQ ID NO: 156366 - RNA, 1701 nt, Artificial Sequence
  derived and/or modified sequence opt4 from hemagglutinin__InfluenzaA__ACZ96339
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacagcuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucaagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156367 - RNA, 1701 nt, Artificial Sequence; identical to SEQ ID NO: 155189
  derived and/or modified sequence opt4 from hemagglutinin__InfluenzaA__ACZ96349

SEQ ID NO: 156368 - RNA, 1701 nt, Artificial Sequence; identical to SEQ ID NO: 156364
  derived and/or modified sequence opt4 from hemagglutinin__InfluenzaA__ACZ96359

SEQ ID NO: 156369 - RNA, 1701 nt, Artificial Sequence; identical to SEQ ID NO: 155189
  derived and/or modified sequence opt4 from hemagglutinin__InfluenzaA__ACZ96372

SEQ ID NO: 156370 - RNA, 1701 nt, Artificial Sequence; identical to SEQ ID NO: 156364
  derived and/or modified sequence opt4 from hemagglutinin__InfluenzaA__ACZ96382

SEQ ID NO: 156371 - RNA, 1701 nt, Artificial Sequence; identical to SEQ ID NO: 155176
  derived and/or modified sequence opt4 from hemagglutinin__InfluenzaA__ACZ96392

SEQ ID NO: 156372 - RNA, 1701 nt, Artificial Sequence; identical to SEQ ID NO: 155431
  derived and/or modified sequence opt4 from hemagglutinin__InfluenzaA__ACZ96405

SEQ ID NO: 156373 - RNA, 1701 nt, Artificial Sequence; identical to SEQ ID NO: 155189
  derived and/or modified sequence opt4 from hemagglutinin__InfluenzaA__ACZ96415

SEQ ID NO: 156374 - RNA, 1701 nt, Artificial Sequence; identical to SEQ ID NO: 155189
  derived and/or modified sequence opt4 from hemagglutinin__InfluenzaA__ACZ96425

SEQ ID NO: 156375 - RNA, 1701 nt, Artificial Sequence
  derived and/or modified sequence opt4 from hemagglutinin__InfluenzaA__ACZ96435
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggcccagcugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugauggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156376 - RNA, 1701 nt, Artificial Sequence; identical to SEQ ID NO: 155189
  derived and/or modified sequence opt4 from hemagglutinin__InfluenzaA__ACZ96445

SEQ ID NO: 156377 - RNA, 1701 nt, Artificial Sequence
  derived and/or modified sequence opt4 from hemagglutinin__InfluenzaA__ACZ96476
augaaggccauccugguggugcugcuguacaccuucgccaccgccuacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156378 - RNA, 1701 nt, Artificial Sequence; identical to SEQ ID NO: 155189
  derived and/or modified sequence opt4 from hemagglutinin__InfluenzaA__ACZ96496

SEQ ID NO: 156379 - RNA, 1701 nt, Artificial Sequence; identical to SEQ ID NO: 155189
  derived and/or modified sequence opt4 from hemagglutinin__InfluenzaA__ACZ96506

SEQ ID NO: 156380 - RNA, 1701 nt, Artificial Sequence; identical to SEQ ID NO: 155189
  derived and/or modified sequence opt4 from hemagglutinin__InfluenzaA__ACZ96526

SEQ ID NO: 156381 - RNA, 1701 nt, Artificial Sequence
  derived and/or modified sequence opt4 from hemagglutinin__InfluenzaA__ACZ96536
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugaagggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcagcagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaagcacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156382 - RNA, 1701 nt, Artificial Sequence; identical to SEQ ID NO: 155189
  derived and/or modified sequence opt4 from hemagglutinin__InfluenzaA__ACZ96549

SEQ ID NO: 156383 - RNA, 1701 nt, Artificial Sequence
  derived and/or modified sequence opt4 from hemagglutinin__InfluenzaA__ACZ96559
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156384 - RNA, 1701 nt, Artificial Sequence
  derived and/or modified sequence opt4 from hemagglutinin__InfluenzaA__ACZ96569
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156385 - RNA, 1701 nt, Artificial Sequence
  derived and/or modified sequence opt4 from hemagglutinin__InfluenzaA__ACZ96579
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcagcagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156386 - RNA, 1701 nt, Artificial Sequence; identical to SEQ ID NO: 155189
  derived and/or modified sequence opt4 from hemagglutinin__InfluenzaA__ACZ96589

SEQ ID NO: 156387 - RNA, 1701 nt, Artificial Sequence
  derived and/or modified sequence opt4 from hemagglutinin__InfluenzaA__ACZ96599
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacaccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156388 - RNA, 1701 nt, Artificial Sequence
  derived and/or modified sequence opt4 from hemagglutinin__InfluenzaA__ACZ96609
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaccugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156389 - RNA, 1701 nt, Artificial Sequence; identical to SEQ ID NO: 155369
  derived and/or modified sequence opt4 from hemagglutinin__InfluenzaA__ACZ96619

SEQ ID NO: 156390 - RNA, 1701 nt, Artificial Sequence; identical to SEQ ID NO: 155369
  derived and/or modified sequence opt4 from hemagglutinin__InfluenzaA__ACZ96629

SEQ ID NO: 156391 - RNA, 1701 nt, Artificial Sequence; identical to SEQ ID NO: 155369
  derived and/or modified sequence opt4 from hemagglutinin__InfluenzaA__ACZ96639

SEQ ID NO: 156392 - RNA, 1701 nt, Artificial Sequence; identical to SEQ ID NO: 155369
  derived and/or modified sequence opt4 from hemagglutinin__InfluenzaA__ACZ96649

SEQ ID NO: 156393 - RNA, 1701 nt, Artificial Sequence; identical to SEQ ID NO: 155369
  derived and/or modified sequence opt4 from hemagglutinin__InfluenzaA__ACZ96659

SEQ ID NO: 156394 - RNA, 1701 nt, Artificial Sequence; identical to SEQ ID NO: 155369
  derived and/or modified sequence opt4 from hemagglutinin__InfluenzaA__ACZ96669

SEQ ID NO: 156395 - RNA, 1701 nt, Artificial Sequence; identical to SEQ ID NO: 155369
  derived and/or modified sequence opt4 from hemagglutinin__InfluenzaA__ACZ96679

SEQ ID NO: 156396 - RNA, 1701 nt, Artificial Sequence; identical to SEQ ID NO: 155369
  derived and/or modified sequence opt4 from hemagglutinin__InfluenzaA__ACZ96689

SEQ ID NO: 156397 - RNA, 1701 nt, Artificial Sequence; identical to SEQ ID NO: 155369
  derived and/or modified sequence opt4 from hemagglutinin__InfluenzaA__ACZ96699

SEQ ID NO: 156398 - RNA, 1701 nt, Artificial Sequence; identical to SEQ ID NO: 155369
  derived and/or modified sequence opt4 from hemagglutinin__InfluenzaA__ACZ96719

SEQ ID NO: 156399 - RNA, 1701 nt, Artificial Sequence; identical to SEQ ID NO: 155369
  derived and/or modified sequence opt4 from hemagglutinin__InfluenzaA__ACZ96729

SEQ ID NO: 156400 - RNA, 1701 nt, Artificial Sequence; identical to SEQ ID NO: 155369
  derived and/or modified sequence opt4 from hemagglutinin__InfluenzaA__ACZ96739

SEQ ID NO: 156401 - RNA, 1701 nt, Artificial Sequence
  derived and/or modified sequence opt4 from hemagglutinin__InfluenzaA__ACZ96749
augaagaccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156402 - RNA, 1701 nt, Artificial Sequence; identical to SEQ ID NO: 155176
  derived and/or modified sequence opt4 from hemagglutinin__InfluenzaA__ACZ96759

SEQ ID NO: 156403 - RNA, 1701 nt, Artificial Sequence; identical to SEQ ID NO: 155176
  derived and/or modified sequence opt4 from hemagglutinin__InfluenzaA__ACZ96769

SEQ ID NO: 156404 - RNA, 1701 nt, Artificial Sequence; identical to SEQ ID NO: 155176
  derived and/or modified sequence opt4 from hemagglutinin__InfluenzaA__ACZ96779

SEQ ID NO: 156405 - RNA, 1701 nt, Artificial Sequence; identical to SEQ ID NO: 155176
  derived and/or modified sequence opt4 from hemagglutinin__InfluenzaA__ACZ96789

SEQ ID NO: 156406 - RNA, 1701 nt, Artificial Sequence
  derived and/or modified sequence opt4 from hemagglutinin__InfluenzaA__ACZ96809
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaacgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucgccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156407 - RNA, 1701 nt, Artificial Sequence; identical to SEQ ID NO: 155176
  derived and/or modified sequence opt4 from hemagglutinin__InfluenzaA__ACZ96819

SEQ ID NO: 156408 - RNA, 1701 nt, Artificial Sequence; identical to SEQ ID NO: 155176
  derived and/or modified sequence opt4 from hemagglutinin__InfluenzaA__ACZ96829

SEQ ID NO: 156409 - RNA, 1701 nt, Artificial Sequence; identical to SEQ ID NO: 155176
  derived and/or modified sequence opt4 from hemagglutinin__InfluenzaA__ACZ96839

SEQ ID NO: 156410 - RNA, 1701 nt, Artificial Sequence; identical to SEQ ID NO: 156329
  derived and/or modified sequence opt4 from hemagglutinin__InfluenzaA__ACZ96849

SEQ ID NO: 156411 - RNA, 1701 nt, Artificial Sequence; identical to SEQ ID NO: 155189
  derived and/or modified sequence opt4 from hemagglutinin__InfluenzaA__ACZ96859

SEQ ID NO: 156412 - RNA, 1701 nt, Artificial Sequence; identical to SEQ ID NO: 155176
  derived and/or modified sequence opt4 from hemagglutinin__InfluenzaA__ACZ96869

SEQ ID NO: 156413 - RNA, 1701 nt, Artificial Sequence; identical to SEQ ID NO: 155176
  derived and/or modified sequence opt4 from hemagglutinin__InfluenzaA__ACZ96879

SEQ ID NO: 156414 - RNA, 1701 nt, Artificial Sequence
  derived and/or modified sequence opt4 from hemagglutinin__InfluenzaA__ACZ96899
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacagcagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156415 - RNA, 1701 nt, Artificial Sequence; identical to SEQ ID NO: 155176
  derived and/or modified sequence opt4 from hemagglutinin__InfluenzaA__ACZ96909

SEQ ID NO: 156416 - RNA, 1701 nt, Artificial Sequence; identical to SEQ ID NO: 155176
  derived and/or modified sequence opt4 from hemagglutinin__InfluenzaA__ACZ96919

SEQ ID NO: 156417 - RNA, 1701 nt, Artificial Sequence; identical to SEQ ID NO: 155176
  derived and/or modified sequence opt4 from hemagglutinin__InfluenzaA__ACZ96929

SEQ ID NO: 156418 - RNA, 1701 nt, Artificial Sequence; identical to SEQ ID NO: 155176
  derived and/or modified sequence opt4 from hemagglutinin__InfluenzaA__ACZ96939

SEQ ID NO: 156419 - RNA, 1701 nt, Artificial Sequence
  derived and/or modified sequence opt4 from hemagglutinin__InfluenzaA__ACZ96949
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagaugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156420 - RNA, 1701 nt, Artificial Sequence; identical to SEQ ID NO: 155176
  derived and/or modified sequence opt4 from hemagglutinin__InfluenzaA__ACZ97021

SEQ ID NO: 156421 - RNA, 1701 nt, Artificial Sequence; identical to SEQ ID NO: 155543
  derived and/or modified sequence opt4 from hemagglutinin__InfluenzaA__ACZ97343

SEQ ID NO: 156422 - RNA, 1701 nt, Artificial Sequence; identical to SEQ ID NO: 155543
  derived and/or modified sequence opt4 from hemagglutinin__InfluenzaA__ACZ97353

SEQ ID NO: 156423 - RNA, 1701 nt, Artificial Sequence; identical to SEQ ID NO: 155176
  derived and/or modified sequence opt4 from hemagglutinin__InfluenzaA__ACZ97363

SEQ ID NO: 156424 - RNA, 1701 nt, Artificial Sequence
  derived and/or modified sequence opt4 from hemagglutinin__InfluenzaA__ACZ97383
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaccagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156425 - RNA, 1701 nt, Artificial Sequence; identical to SEQ ID NO: 155176
  derived and/or modified sequence opt4 from hemagglutinin__InfluenzaA__ACZ97393

SEQ ID NO: 156426 - RNA, 1701 nt, Artificial Sequence
  derived and/or modified sequence opt4 from hemagglutinin__InfluenzaA__ACZ98178
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacuacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156427 - RNA, 1701 nt, Artificial Sequence; identical to SEQ ID NO: 155176
  derived and/or modified sequence opt4 from hemagglutinin__InfluenzaA__ACZ98188

SEQ ID NO: 156428 - RNA, 1701 nt, Artificial Sequence; identical to SEQ ID NO: 155369
  derived and/or modified sequence opt4 from hemagglutinin__InfluenzaA__ACZ98198

SEQ ID NO: 156429 - RNA, 1701 nt, Artificial Sequence; identical to SEQ ID NO: 155189
  derived and/or modified sequence opt4 from hemagglutinin__InfluenzaA__ACZ98208

SEQ ID NO: 156430 - RNA, 1701 nt, Artificial Sequence; identical to SEQ ID NO: 155189
  derived and/or modified sequence opt4 from hemagglutinin__InfluenzaA__ACZ98218

SEQ ID NO: 156431 - RNA, 1701 nt, Artificial Sequence; identical to SEQ ID NO: 155189
  derived and/or modified sequence opt4 from hemagglutinin__InfluenzaA__ACZ98228

SEQ ID NO: 156432 - RNA, 1701 nt, Artificial Sequence; identical to SEQ ID NO: 155189
  derived and/or modified sequence opt4 from hemagglutinin__InfluenzaA__ACZ98238

SEQ ID NO: 156433 - RNA, 1701 nt, Artificial Sequence; identical to SEQ ID NO: 155818
  derived and/or modified sequence opt4 from hemagglutinin__InfluenzaA__ACZ98248

SEQ ID NO: 156434 - RNA, 1701 nt, Artificial Sequence; identical to SEQ ID NO: 155189
  derived and/or modified sequence opt4 from hemagglutinin__InfluenzaA__ACZ98258

SEQ ID NO: 156435 - RNA, 1701 nt, Artificial Sequence; identical to SEQ ID NO: 155189
  derived and/or modified sequence opt4 from hemagglutinin__InfluenzaA__ACZ98268

SEQ ID NO: 156436 - RNA, 1701 nt, Artificial Sequence; identical to SEQ ID NO: 156329
  derived and/or modified sequence opt4 from hemagglutinin__InfluenzaA__ACZ98278

SEQ ID NO: 156437 - RNA, 1701 nt, Artificial Sequence; identical to SEQ ID NO: 156329
  derived and/or modified sequence opt4 from hemagglutinin__InfluenzaA__ACZ98288

SEQ ID NO: 156438 - RNA, 1701 nt, Artificial Sequence
  derived and/or modified sequence opt4 from hemagglutinin__InfluenzaA__ACZ98298
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagaaguucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156439 - RNA, 1701 nt, Artificial Sequence
  derived and/or modified sequence opt4 from hemagglutinin__InfluenzaA__ACZ98318
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccacauccuggccaucuacagcaccguggccagcagccuggugcugguggugagccugggcgccaucagcuucuggaugugcagcaacggcagccugcagugcagaaucugcaucuga

SEQ ID NO: 156440 - RNA, 1701 nt, Artificial Sequence; identical to SEQ ID NO: 155431
  derived and/or modified sequence opt4 from hemagglutinin__InfluenzaA__ACZ98328

SEQ ID NO: 156441 - RNA, 1701 nt, Artificial Sequence; identical to SEQ ID NO: 155189
  derived and/or modified sequence opt4 from hemagglutinin__InfluenzaA__ACZ98338

SEQ ID NO: 156442 - RNA, 1701 nt, Artificial Sequence; identical to SEQ ID NO: 156329
  derived and/or modified sequence opt4 from hemagglutinin__InfluenzaA__ACZ98348

SEQ ID NO: 156443 - RNA, 1701 nt, Artificial Sequence; identical to SEQ ID NO: 155189
  derived and/or modified sequence opt4 from hemagglutinin__InfluenzaA__ACZ98358

SEQ ID NO: 156444 - RNA, 1701 nt, Artificial Sequence; identical to SEQ ID NO: 155189
  derived and/or modified sequence opt4 from hemagglutinin__InfluenzaA__ACZ98368

SEQ ID NO: 156445 - RNA, 1701 nt, Artificial Sequence; identical to SEQ ID NO: 155431
  derived and/or modified sequence opt4 from hemagglutinin__InfluenzaA__ACZ98388

SEQ ID NO: 156446 - RNA, 1701 nt, Artificial Sequence; identical to SEQ ID NO: 155189
  derived and/or modified sequence opt4 from hemagglutinin__InfluenzaA__ACZ98398

SEQ ID NO: 156447 - RNA, 1701 nt, Artificial Sequence; identical to SEQ ID NO: 155189
  derived and/or modified sequence opt4 from hemagglutinin__InfluenzaA__ACZ98408

SEQ ID NO: 156448 - RNA, 1701 nt, Artificial Sequence; identical to SEQ ID NO: 155369
  derived and/or modified sequence opt4 from hemagglutinin__InfluenzaA__ACZ98418

SEQ ID NO: 156449 - RNA, 1701 nt, Artificial Sequence; identical to SEQ ID NO: 155189
  derived and/or modified sequence opt4 from hemagglutinin__InfluenzaA__ACZ98428

SEQ ID NO: 156450 - RNA, 1701 nt, Artificial Sequence; identical to SEQ ID NO: 155189
  derived and/or modified sequence opt4 from hemagglutinin__InfluenzaA__ACZ98438

SEQ ID NO: 156451 - RNA, 1701 nt, Artificial Sequence; identical to SEQ ID NO: 155189
  derived and/or modified sequence opt4 from hemagglutinin__InfluenzaA__ACZ98448

SEQ ID NO: 156452 - RNA, 1701 nt, Artificial Sequence; identical to SEQ ID NO: 156329
  derived and/or modified sequence opt4 from hemagglutinin__InfluenzaA__ACZ98458

SEQ ID NO: 156453 - RNA, 1701 nt, Artificial Sequence
  derived and/or modified sequence opt4 from hemagglutinin__InfluenzaA__ACZ98546
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacugaccaccggccugagaaacgugcccagcauccaguacagaggccuguucggcgccaucaccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156454 - RNA, 1701 nt, Artificial Sequence
  derived and/or modified sequence opt4 from hemagglutinin__InfluenzaA__ACZ98560
augaaggccaucagaguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagccccaagcugagacuggccaccggcaugagaaacgugcccuucauccaguacagaggccuguucggcgccaucaccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156455 - RNA, 1701 nt, Artificial Sequence
  derived and/or modified sequence opt4 from hemagglutinin__InfluenzaA__ACZ98567
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagccccaagcugagacuggccagcggcaugagaaacgugcccuucauccagagcagaggccuguucggcgccaucaccggcuucaucgaggagggcuggaccggcaugguggacggcugguacggcuuccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156456 - RNA, 1701 nt, Artificial Sequence; identical to SEQ ID NO: 155176
  derived and/or modified sequence opt4 from hemagglutinin__InfluenzaA__ACZ98671

SEQ ID NO: 156457 - RNA, 1701 nt, Artificial Sequence; identical to SEQ ID NO: 155176
  derived and/or modified sequence opt4 from hemagglutinin__InfluenzaA__ACZ98681

SEQ ID NO: 156458 - RNA, 1701 nt, Artificial Sequence; identical to SEQ ID NO: 155189
  derived and/or modified sequence opt4 from hemagglutinin__InfluenzaA__ACZ98691

SEQ ID NO: 156459 - RNA, 1701 nt, Artificial Sequence
  derived and/or modified sequence opt4 from hemagglutinin__InfluenzaA__ADA60799
augaaggccauccugguggugcugcuguacaccuucgccaccgccaacgccgacacccugugcaucggcuaccacgccaacaacagcaccgacaccguggacaccgugcuggagagaaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156460 - RNA, 1701 nt, Artificial Sequence; identical to SEQ ID NO: 156353
  derived and/or modified sequence opt4 from hemagglutinin__InfluenzaA__ADA69302

SEQ ID NO: 156461 - RNA, 1701 nt, Artificial Sequence; identical to SEQ ID NO: 156353
  derived and/or modified sequence opt4 from hemagglutinin__InfluenzaA__ADA69312

SEQ ID NO: 156462 - RNA, 1701 nt, Artificial Sequence; identical to SEQ ID NO: 156353
  derived and/or modified sequence opt4 from hemagglutinin__InfluenzaA__ADA69322

SEQ ID NO: 156463 - RNA, 1701 nt, Artificial Sequence; identical to SEQ ID NO: 156353
  derived and/or modified sequence opt4 from hemagglutinin__InfluenzaA__ADA69332

SEQ ID NO: 156464 - RNA, 1701 nt, Artificial Sequence; identical to SEQ ID NO: 156290
  derived and/or modified sequence opt4 from hemagglutinin__InfluenzaA__ADA70329

SEQ ID NO: 156465 - RNA, 1698 nt, Artificial Sequence
  derived and/or modified sequence opt4 from hemagglutinin__InfluenzaA__ADA71150
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugguggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucagcaaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaagaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156466 - RNA, 1701 nt, Artificial Sequence
  derived and/or modified sequence opt4 from hemagglutinin__InfluenzaA__ADA71152
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcggcaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 156467 - RNA, 1698 nt, Artificial Sequence
  derived and/or modified sequence opt4 from hemagglutinin__InfluenzaA__ADA71154
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaacagcgagugcgagcugcugaucagcaaggagagcuggagcuacaucguggagaagcccaaccccgagaacggcaccugcuacuucggccacuucgccgacuacgaggagcugagagagcaguucggcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucaacgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccagagacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156468 - RNA, 1698 nt, Artificial Sequence
  derived and/or modified sequence opt4 from hemagglutinin__InfluenzaA__ADA71158
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagaccuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccagcaucaacgaccagagaacccuguaccacaccgagaacgccuacgugagcguggugagcagccacuacagcagaaaguucacccccgagaucgccaagagacccaaggugagagaccaggagggcagaaucaacuacuacuggacccugcuggagcccagagacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacacccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagccugauggacauccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156469 - RNA, 1701 nt, Artificial Sequence; identical to SEQ ID NO: 154954
  derived and/or modified sequence opt4 from hemagglutinin__InfluenzaA__ADA71162

SEQ ID NO: 156470 - RNA, 1698 nt, Artificial Sequence
  derived and/or modified sequence opt4 from hemagglutinin__InfluenzaA__ADA71164
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcuggugagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgccagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccagcaucgccgaccagaagacccuguaccacaccgagaacgccuacgugagcguggugagcagccacuacagcagaaaguucacccccgagaucgccaagagacccaaggugagagaccaggagggcagaauccacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaccugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaucagccagcugaagaucaacgccaaggaccugggcuacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156471 - RNA, 1698 nt, Artificial Sequence
  derived and/or modified sequence opt4 from hemagglutinin__InfluenzaA__ADA71168
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaaggccccccugcagcugggcaacugcagcguggccggcuggauccugggcaaccccgagugcggccugcugaucagcaaggagagcuggagcuacaucguggagagacccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgugcagaugacccuguaccacaaggagaacgccuacgugagcguggugagcagccacuacagcagaaaguucacccccgagaucgugaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156472 - RNA, 1698 nt, Artificial Sequence
  derived and/or modified sequence opt4 from hemagglutinin__InfluenzaA__ADA71170
augaaggugaagcugcuggugcugcugugcaccuucaccgccaccuacgccgacaccaucugcaucggcuaccacgccaacaacagcaccgacaccguggacaccgugcuggagaagaacggcaccgugacccccagcggcaaccugguggagaacagccccaacggcaagcugugccugcugaagggcaucaccccccugcagcugggcaagugcagcguggccggcuggauccugggcaaccccaagugggagcugcuggugagcaaggagagcuggagcuacaucggcaagaagcccaaccccgagaacggcaccugcuaccccggccacuuccccuacuacgaggagcugagagagcagcugagcagcgugagcagcuucgagagauucgagaucuuccccaaggagagcagcuggcccaaccacaccgugaccggcgccagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156473 - RNA, 1701 nt, Artificial Sequence
  derived and/or modified sequence opt4 from hemagglutinin__InfluenzaA__ADA71172
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 156474 - RNA, 1698 nt, Artificial Sequence
  derived and/or modified sequence opt4 from hemagglutinin__InfluenzaA__ADA71176
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgccagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccaaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaccugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156475 - RNA, 1701 nt, Artificial Sequence; identical to SEQ ID NO: 156290
  derived and/or modified sequence opt4 from hemagglutinin__InfluenzaA__ADA71181

SEQ ID NO: 156476 - RNA, 1701 nt, Artificial Sequence; identical to SEQ ID NO: 156290
  derived and/or modified sequence opt4 from hemagglutinin__InfluenzaA__ADA71191

SEQ ID NO: 156477 - RNA, 1701 nt, Artificial Sequence
  derived and/or modified sequence opt4 from hemagglutinin__InfluenzaA__ADA79587
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccaacagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156478 - RNA, 1701 nt, Artificial Sequence
  derived and/or modified sequence opt4 from hemagglutinin__InfluenzaA__ADA79607
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagggcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156479 - RNA, 1701 nt, Artificial Sequence
  derived and/or modified sequence opt4 from hemagglutinin__InfluenzaA__ADA83043
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156480 - RNA, 1701 nt, Artificial Sequence
  derived and/or modified sequence opt4 from hemagglutinin__InfluenzaA__ADA83044
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcaacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaaggagaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcgacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156481 - RNA, 1701 nt, Artificial Sequence; identical to SEQ ID NO: 155189
  derived and/or modified sequence opt4 from hemagglutinin__InfluenzaA__ADA83580

SEQ ID NO: 156482 - RNA, 1701 nt, Artificial Sequence; identical to SEQ ID NO: 155189
  derived and/or modified sequence opt4 from hemagglutinin__InfluenzaA__ADA83587

SEQ ID NO: 156483 - RNA, 1701 nt, Artificial Sequence
  derived and/or modified sequence opt4 from hemagglutinin__InfluenzaA__ADA83591
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucagcaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156484 - RNA, 1701 nt, Artificial Sequence; identical to SEQ ID NO: 155934
  derived and/or modified sequence opt4 from hemagglutinin__InfluenzaA__ADA83595

SEQ ID NO: 156485 - RNA, 1701 nt, Artificial Sequence; identical to SEQ ID NO: 155189
  derived and/or modified sequence opt4 from hemagglutinin__InfluenzaA__ADA83599

SEQ ID NO: 156486 - RNA, 1701 nt, Artificial Sequence; identical to SEQ ID NO: 155189
  derived and/or modified sequence opt4 from hemagglutinin__InfluenzaA__ADA83603

SEQ ID NO: 156487 - RNA, 1701 nt, Artificial Sequence; identical to SEQ ID NO: 155189
  derived and/or modified sequence opt4 from hemagglutinin__InfluenzaA__ADA83611

SEQ ID NO: 156488 - RNA, 1701 nt, Artificial Sequence
  derived and/or modified sequence opt4 from hemagglutinin__InfluenzaA__ADA83615
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgaccugaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156489 - RNA, 1701 nt, Artificial Sequence
  derived and/or modified sequence opt4 from hemagglutinin__InfluenzaA__ADA83622
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagacuguaccagaacgccgacgccuacguguucgugggcaccagcagauacagcaagaagcugaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156490 - RNA, 1701 nt, Artificial Sequence; identical to SEQ ID NO: 155189
  derived and/or modified sequence opt4 from hemagglutinin__InfluenzaA__ADA83633

SEQ ID NO: 156491 - RNA, 1701 nt, Artificial Sequence; identical to SEQ ID NO: 155189
  derived and/or modified sequence opt4 from hemagglutinin__InfluenzaA__ADA83637

SEQ ID NO: 156492 - RNA, 1701 nt, Artificial Sequence; identical to SEQ ID NO: 155189
  derived and/or modified sequence opt4 from hemagglutinin__InfluenzaA__ADA83641

SEQ ID NO: 156493 - RNA, 1701 nt, Artificial Sequence; identical to SEQ ID NO: 155189
  derived and/or modified sequence opt4 from hemagglutinin__InfluenzaA__ADA83645

SEQ ID NO: 156494 - RNA, 1701 nt, Artificial Sequence; identical to SEQ ID NO: 155189
  derived and/or modified sequence opt4 from hemagglutinin__InfluenzaA__ADA83648

SEQ ID NO: 156495 - RNA, 1701 nt, Artificial Sequence; identical to SEQ ID NO: 155189
  derived and/or modified sequence opt4 from hemagglutinin__InfluenzaA__ADA83656

SEQ ID NO: 156496 - RNA, 1701 nt, Artificial Sequence; identical to SEQ ID NO: 155189
  derived and/or modified sequence opt4 from hemagglutinin__InfluenzaA__ADA83660

SEQ ID NO: 156497 - RNA, 1701 nt, Artificial Sequence
  derived and/or modified sequence opt4 from hemagglutinin__InfluenzaA__ADA83664
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaccgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156498 - RNA, 1701 nt, Artificial Sequence
  derived and/or modified sequence opt4 from hemagglutinin__InfluenzaA__ADA83668
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcggcagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156499 - RNA, 1701 nt, Artificial Sequence; identical to SEQ ID NO: 155189
  derived and/or modified sequence opt4 from hemagglutinin__InfluenzaA__ADA83672

SEQ ID NO: 156500 - RNA, 1701 nt, Artificial Sequence; identical to SEQ ID NO: 155189
  derived and/or modified sequence opt4 from hemagglutinin__InfluenzaA__ADA83676

SEQ ID NO: 156501 - RNA, 1701 nt, Artificial Sequence; identical to SEQ ID NO: 155189
  derived and/or modified sequence opt4 from hemagglutinin__InfluenzaA__ADA83680

SEQ ID NO: 156502 - RNA, 1701 nt, Artificial Sequence
  derived and/or modified sequence opt4 from hemagglutinin__InfluenzaA__ADA86068
augaaggccauccugguggugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaaaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaucaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156503 - RNA, 1701 nt, Artificial Sequence
  derived and/or modified sequence opt4 from hemagglutinin__InfluenzaA__ADA86086
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaacgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156504 - RNA, 1701 nt, Artificial Sequence
  derived and/or modified sequence opt4 from hemagglutinin__InfluenzaA__ADA86087
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccuucagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgcccugaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156505 - RNA, 1701 nt, Artificial Sequence; identical to SEQ ID NO: 155987
  derived and/or modified sequence opt4 from hemagglutinin__InfluenzaA__ADA86088

SEQ ID NO: 156506 - RNA, 1701 nt, Artificial Sequence
  derived and/or modified sequence opt4 from hemagglutinin__InfluenzaA__ADB03603
augaaggccauccugaucgugcugcuguacaccuucgccaccgcccacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaauggacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156507 - RNA, 1701 nt, Artificial Sequence; identical to SEQ ID NO: 155176
  derived and/or modified sequence opt4 from hemagglutinin__InfluenzaA__ADB03604

SEQ ID NO: 156508 - RNA, 1701 nt, Artificial Sequence
  derived and/or modified sequence opt4 from hemagglutinin__InfluenzaA__ADB03605
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaauggacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156509 - RNA, 1701 nt, Artificial Sequence; identical to SEQ ID NO: 155189
  derived and/or modified sequence opt4 from hemagglutinin__InfluenzaA__ADB03607

SEQ ID NO: 156510 - RNA, 1701 nt, Artificial Sequence; identical to SEQ ID NO: 155542
  derived and/or modified sequence opt4 from hemagglutinin__InfluenzaA__ADB03609

SEQ ID NO: 156511 - RNA, 1701 nt, Artificial Sequence; identical to SEQ ID NO: 155189
  derived and/or modified sequence opt4 from hemagglutinin__InfluenzaA__ADB03611

SEQ ID NO: 156512 - RNA, 1701 nt, Artificial Sequence
  derived and/or modified sequence opt4 from hemagglutinin__InfluenzaA__ADB03612
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccuucauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156513 - RNA, 1701 nt, Artificial Sequence; identical to SEQ ID NO: 155189
  derived and/or modified sequence opt4 from hemagglutinin__InfluenzaA__ADB03614

SEQ ID NO: 156514 - RNA, 1701 nt, Artificial Sequence
  derived and/or modified sequence opt4 from hemagglutinin__InfluenzaA__ADB03617
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcaaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156515 - RNA, 1701 nt, Artificial Sequence; identical to SEQ ID NO: 155542
  derived and/or modified sequence opt4 from hemagglutinin__InfluenzaA__ADB03619

SEQ ID NO: 156516 - RNA, 1701 nt, Artificial Sequence
  derived and/or modified sequence opt4 from hemagglutinin__InfluenzaA__ADB03620
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggagggcaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucgugcccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156517 - RNA, 1701 nt, Artificial Sequence
  derived and/or modified sequence opt4 from hemagglutinin__InfluenzaA__ADB03622
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaacggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156518 - RNA, 1701 nt, Artificial Sequence; identical to SEQ ID NO: 156517
  derived and/or modified sequence opt4 from hemagglutinin__InfluenzaA__ADB03623

SEQ ID NO: 156519 - RNA, 1701 nt, Artificial Sequence
  derived and/or modified sequence opt4 from hemagglutinin__InfluenzaA__ADB03628
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156520 - RNA, 1701 nt, Artificial Sequence
  derived and/or modified sequence opt4 from hemagglutinin__InfluenzaA__ADB03629
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuuccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156521 - RNA, 1701 nt, Artificial Sequence
  derived and/or modified sequence opt4 from hemagglutinin__InfluenzaA__ADB03630
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuaccacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcaaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156522 - RNA, 1701 nt, Artificial Sequence; identical to SEQ ID NO: 155934
  derived and/or modified sequence opt4 from hemagglutinin__InfluenzaA__ADB25319

SEQ ID NO: 156523 - RNA, 1701 nt, Artificial Sequence; identical to SEQ ID NO: 155189
  derived and/or modified sequence opt4 from hemagglutinin__InfluenzaA__ADB25321

SEQ ID NO: 156524 - RNA, 1701 nt, Artificial Sequence
  derived and/or modified sequence opt4 from hemagglutinin__InfluenzaA__ADB27970
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156525 - RNA, 1701 nt, Artificial Sequence; identical to SEQ ID NO: 155189
  derived and/or modified sequence opt4 from hemagglutinin__InfluenzaA__ADB27980

SEQ ID NO: 156526 - RNA, 1701 nt, Artificial Sequence; identical to SEQ ID NO: 155189
  derived and/or modified sequence opt4 from hemagglutinin__InfluenzaA__ADB54352

SEQ ID NO: 156527 - RNA, 1701 nt, Artificial Sequence; identical to SEQ ID NO: 155189
  derived and/or modified sequence opt4 from hemagglutinin__InfluenzaA__ADB54355

SEQ ID NO: 156528 - RNA, 1698 nt, Artificial Sequence
  derived and/or modified sequence opt4 from hemagglutinin__InfluenzaA__ADB65926
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaagcacaacggcaagcugugccugcugaagggcaaggccccccugcagcugggcaacugcagcguggccggcuggauccugggcaaccccgagugcggccugcugaucagcaaggagagcuggagcuacaucguggagagacccaaccccgagaacggcaccugcuaccccggccacuucgccgacuacgaggagcugagagagcagcugagcagcgugagcagcuucgagagauucgagaucuuccccaagggcagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaugacccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagaaccagcugaagaacaacgccaaggagaugggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucggcuucuggaugugcagcaacggcagccugcagugcagaaucugcaucuga

SEQ ID NO: 156529 - RNA, 1698 nt, Artificial Sequence
  derived and/or modified sequence opt4 from hemagglutinin__InfluenzaA__ADB80153
augaaggugaagcugcuggcccugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuucgccaacaacaaggagaaggaggugcuggugcuguggggcgugcaccacccccccaacaucggcgaccagaugacccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156530 - RNA, 1701 nt, Artificial Sequence; identical to SEQ ID NO: 156290
  derived and/or modified sequence opt4 from hemagglutinin__InfluenzaA__ADB81399

SEQ ID NO: 156531 - RNA, 1701 nt, Artificial Sequence; identical to SEQ ID NO: 156290
  derived and/or modified sequence opt4 from hemagglutinin__InfluenzaA__ADB81409

SEQ ID NO: 156532 - RNA, 1701 nt, Artificial Sequence
  derived and/or modified sequence opt4 from hemagglutinin__InfluenzaA__ADB81419
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccgaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156533 - RNA, 1701 nt, Artificial Sequence; identical to SEQ ID NO: 156349
  derived and/or modified sequence opt4 from hemagglutinin__InfluenzaA__ADB81429

SEQ ID NO: 156534 - RNA, 1701 nt, Artificial Sequence
  derived and/or modified sequence opt4 from hemagglutinin__InfluenzaA__ADB81439
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaaaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156535 - RNA, 1701 nt, Artificial Sequence
  derived and/or modified sequence opt4 from hemagglutinin__InfluenzaA__ADB81449
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156536 - RNA, 1701 nt, Artificial Sequence
  derived and/or modified sequence opt4 from hemagglutinin__InfluenzaA__ADB81459
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacggcggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156537 - RNA, 1701 nt, Artificial Sequence
  derived and/or modified sequence opt4 from hemagglutinin__InfluenzaA__ADB82655
augaaggccauccugcuggugcugcugugcacccuggccgccgccaacgccgacacccugugcaucggcuaccacgccaacaacagcaccgacaccguggacaccgugcuggagaagaacgugaccgugacccacagcgugaaccugcuggaggacagacacaacggcaagcugugcaaccugagaggcaaggccccccugcaccugggcaagugcaacaucgccggcuggcugcugggcaaccccgagugcgagcugcuguucgccgugaacagcuggagcuacaucguggagaccagcaacagcgacaacggcaccugcuaccccggcgacuucaccagcuacgaggagcugagagagcagcugagcagcgugagcagcuucgagagauucgagaucuuccccaaggccagcagcuggcccaaccacgagaccaacagaggcgugaccgccgccugccccuacgccggcaccaacggcuucuacagaaaccugaucuggcuggugaagaaggagaacagcuaccccaagcugagaaagagcuacgugaacaacaagaagaaggaggugcuggugcuguggggcauccaccacccccccaccaacaccgaccagcagagccuguaccagaacgccgacgccuacguguucgugggcagcagcaaguacagcagaaaguucaagcccgagaucgccgagagacccaaggugagaggccaggccggcagaaugaacuacuacuggacccugaucgagcccggcgacaccaucaccuucgaggccaccggcaaccugguggcccccagauacgccuucgccaugaacagaggccccgugagcggcaucaucaccagcgacgcccccgugcacgacugcaacgccaccugccagacccccaagggcgccaucaacaccagccugcccuuccagaacauccaccccaucaccaucggcgagugccccaaguacgugaagagcaccagacugagaauggccaccggccugagaaacauccccagcauccagagcagaggccuguucggcgccaucgccggcuucaucgagggcggcuggaccggcaugaucgacggcugguacggcuaccaccaccagaacggccagggcagcggcuacgccgccgaccagaagagcacccagaacgccaucgacagaaucaccaacaaggugaacagcgugaucgagaagaugaacauccaguucaccgccgugggcaaggaguucaaccaccuggagagaagaaucgagaaccugaacaagaagguggacgacggcuuccuggacguguggaccuacaacgccgagcugcuggugcugcuggagaacgagagaacccuggacuuccacgacagcaacgugaagacccuguacgagaaggugaagacccagcugagaaacaacgccaaggagaucggcaacggcugcuucgaguucuaccacaagugcgacgacaccugcauggagagcaucaagaacggcaccuacaacuaccccaaguacagcgaggagagcaagcugaacagagaggagaucgacggcgugaagcuggagagcaccagaaucuaccagauccuggccaucuacagcaccgccgccagcagccuggugcugcuggugagccugggcgccaucggcuucuggaugugcagcaacggcagccugcagugcagaaucugcaucuga

SEQ ID NO: 156538 - RNA, 1701 nt, Artificial Sequence
  derived and/or modified sequence opt4 from hemagglutinin__InfluenzaA__ADB82656
augaaggccauccugcuggugcugcagugcauccugaccgccgccaacgccgacacccugugcaucggcuaccacgccaacaacagcaccgacaccguggacaccgugcuggagaagaacgugaccgugacccacagcgugaaccugcuggaggacagacacaacggcaagcugugcaagcugaagggcaucgccccccugcaccugggcaagugcaacaucgccggcuggcugcugggcaaccccgagugcgagcugcuguucaaggccaacagcuggagcuacaucguggagaccagcuacagcgacaacggcaccugcuaccccggcgacuucaccaacuacgaggagcugagagagcagcugagcagcgugagcagcuucgagagauucgagauguuccccaaggccaacagcuggcccaaccacgagaccaacaagggcgugaccgccgccugccccuacgccggcgccaacagcuucuacagaaaccugaucuggcuggugaagaagggcaacagcuaccccagacugagcaagagcuacgugaacaacaagaagaaggaggugcuggugcuguggggcauccaccaccccagcaccagcaccgaccagcagagccuguaccagaacgccgacgccuacguguucgugagcagcagcaccuacaacaagagauucaagcccgagaucggcaccagacccaaggugagagaccagagcggcagaaugaacuacuacuggaccaucguggagcccggcgacaccaucaccuucgaggccaccggcaaccugguggcccccagauacgccuucgccaugaagagagacagcggcagcggcaucaucaugagcgacacccccgugcacgacugcaacaccaccugccagacccccaagggcgccaucaacaccagccugcccuuccagaacgugcaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacagaaagagcacccagaacgccaucgacggcaucaccaacaaggugaacagcaucaucgagaagaugaacauccaguucaccgccgugggcaaggaguucagccaccuggagaagagaguggagaaccugaacaagaagguggacgacggcuuccuggacguguggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacagcugcauggagagcaucaagaacgagaccuacgacuacagcaaguacagcgaggagagcagacugaacagagagaagaucgacggcgugaagcuggagagcacccagaucuaccagauccuggccaucuacagcaccguggccagcagccuggugcugcuggugagccugggcgccaucagcuucuggaugugcagcaacggcagccugcagugcagaaucugcaucuga

SEQ ID NO: 156539 - RNA, 1701 nt, Artificial Sequence
  derived and/or modified sequence opt4 from hemagglutinin__InfluenzaA__ADB82944
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156540 - RNA, 1701 nt, Artificial Sequence
  derived and/or modified sequence opt4 from hemagglutinin__InfluenzaA__ADB82950
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucgagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156541 - RNA, 1701 nt, Artificial Sequence; identical to SEQ ID NO: 155987
  derived and/or modified sequence opt4 from hemagglutinin__InfluenzaA__ADB89129

SEQ ID NO: 156542 - RNA, 1701 nt, Artificial Sequence; identical to SEQ ID NO: 155189
  derived and/or modified sequence opt4 from hemagglutinin__InfluenzaA__ADB89139

SEQ ID NO: 156543 - RNA, 1701 nt, Artificial Sequence
  derived and/or modified sequence opt4 from hemagglutinin__InfluenzaA__ADB89149
augaaggccauccugguggugcugcuguacaccuucgccaccgccaacgccuacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgugggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156544 - RNA, 1701 nt, Artificial Sequence; identical to SEQ ID NO: 155542
  derived and/or modified sequence opt4 from hemagglutinin__InfluenzaA__ADB89150

SEQ ID NO: 156545 - RNA, 1701 nt, Artificial Sequence
  derived and/or modified sequence opt4 from hemagglutinin__InfluenzaA__ADB89221
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagaaccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156546 - RNA, 1701 nt, Artificial Sequence; identical to SEQ ID NO: 155242
  derived and/or modified sequence opt4 from hemagglutinin__InfluenzaA__ADB89241

SEQ ID NO: 156547 - RNA, 1701 nt, Artificial Sequence; identical to SEQ ID NO: 155189
  derived and/or modified sequence opt4 from hemagglutinin__InfluenzaA__ADB89251

SEQ ID NO: 156548 - RNA, 1701 nt, Artificial Sequence; identical to SEQ ID NO: 155636
  derived and/or modified sequence opt4 from hemagglutinin__InfluenzaA__ADB89261

SEQ ID NO: 156549 - RNA, 1701 nt, Artificial Sequence
  derived and/or modified sequence opt4 from hemagglutinin__InfluenzaA__ADB89271
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcaugggcagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156550 - RNA, 1701 nt, Artificial Sequence
  derived and/or modified sequence opt4 from hemagglutinin__InfluenzaA__ADB89281
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156551 - RNA, 1701 nt, Artificial Sequence; identical to SEQ ID NO: 155189
  derived and/or modified sequence opt4 from hemagglutinin__InfluenzaA__ADB89291

SEQ ID NO: 156552 - RNA, 1701 nt, Artificial Sequence; identical to SEQ ID NO: 155189
  derived and/or modified sequence opt4 from hemagglutinin__InfluenzaA__ADB89301

SEQ ID NO: 156553 - RNA, 1701 nt, Artificial Sequence; identical to SEQ ID NO: 155189
  derived and/or modified sequence opt4 from hemagglutinin__InfluenzaA__ADB89311

SEQ ID NO: 156554 - RNA, 1701 nt, Artificial Sequence
  derived and/or modified sequence opt4 from hemagglutinin__InfluenzaA__ADB89321
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcgagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156555 - RNA, 1701 nt, Artificial Sequence
  derived and/or modified sequence opt4 from hemagglutinin__InfluenzaA__ADB89331
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaguguaccagauccuggccaucuacagcaccguggccagcagccuggugcugguggugagccugggcgccaucagcuucuggaugugcagcaacggcagccugcagugcagaaucugcaucuga

SEQ ID NO: 156556 - RNA, 1701 nt, Artificial Sequence; identical to SEQ ID NO: 155189
  derived and/or modified sequence opt4 from hemagglutinin__InfluenzaA__ADB89341

SEQ ID NO: 156557 - RNA, 1701 nt, Artificial Sequence; identical to SEQ ID NO: 155189
  derived and/or modified sequence opt4 from hemagglutinin__InfluenzaA__ADB89351

SEQ ID NO: 156558 - RNA, 1701 nt, Artificial Sequence; identical to SEQ ID NO: 155189
  derived and/or modified sequence opt4 from hemagglutinin__InfluenzaA__ADB89361

SEQ ID NO: 156559 - RNA, 1701 nt, Artificial Sequence; identical to SEQ ID NO: 155189
  derived and/or modified sequence opt4 from hemagglutinin__InfluenzaA__ADB89371

SEQ ID NO: 156560 - RNA, 1701 nt, Artificial Sequence; identical to SEQ ID NO: 155934
  derived and/or modified sequence opt4 from hemagglutinin__InfluenzaA__ADB89381

SEQ ID NO: 156561 - RNA, 1701 nt, Artificial Sequence
  derived and/or modified sequence opt4 from hemagglutinin__InfluenzaA__ADB89391
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugccugcacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugaucgacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156562 - RNA, 1701 nt, Artificial Sequence; identical to SEQ ID NO: 155176
  derived and/or modified sequence opt4 from hemagglutinin__InfluenzaA__ADB89401

SEQ ID NO: 156563 - RNA, 1701 nt, Artificial Sequence; identical to SEQ ID NO: 155189
  derived and/or modified sequence opt4 from hemagglutinin__InfluenzaA__ADB89411

SEQ ID NO: 156564 - RNA, 1701 nt, Artificial Sequence; identical to SEQ ID NO: 155636
  derived and/or modified sequence opt4 from hemagglutinin__InfluenzaA__ADB89431

SEQ ID NO: 156565 - RNA, 1701 nt, Artificial Sequence; identical to SEQ ID NO: 155542
  derived and/or modified sequence opt4 from hemagglutinin__InfluenzaA__ADB89441

SEQ ID NO: 156566 - RNA, 1701 nt, Artificial Sequence; identical to SEQ ID NO: 155189
  derived and/or modified sequence opt4 from hemagglutinin__InfluenzaA__ADB89461

SEQ ID NO: 156567 - RNA, 1701 nt, Artificial Sequence; identical to SEQ ID NO: 155636
  derived and/or modified sequence opt4 from hemagglutinin__InfluenzaA__ADB89481

SEQ ID NO: 156568 - RNA, 1701 nt, Artificial Sequence; identical to SEQ ID NO: 155636
  derived and/or modified sequence opt4 from hemagglutinin__InfluenzaA__ADB89491

SEQ ID NO: 156569 - RNA, 1701 nt, Artificial Sequence
  derived and/or modified sequence opt4 from hemagglutinin__InfluenzaA__ADB89501
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggccugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156570 - RNA, 1701 nt, Artificial Sequence; identical to SEQ ID NO: 155189
  derived and/or modified sequence opt4 from hemagglutinin__InfluenzaA__ADB89511

SEQ ID NO: 156571 - RNA, 1701 nt, Artificial Sequence; identical to SEQ ID NO: 155636
  derived and/or modified sequence opt4 from hemagglutinin__InfluenzaA__ADB89531

SEQ ID NO: 156572 - RNA, 1701 nt, Artificial Sequence; identical to SEQ ID NO: 155636
  derived and/or modified sequence opt4 from hemagglutinin__InfluenzaA__ADB89541

SEQ ID NO: 156573 - RNA, 1701 nt, Artificial Sequence; identical to SEQ ID NO: 156349
  derived and/or modified sequence opt4 from hemagglutinin__InfluenzaA__ADB89551

SEQ ID NO: 156574 - RNA, 1701 nt, Artificial Sequence; identical to SEQ ID NO: 155189
  derived and/or modified sequence opt4 from hemagglutinin__InfluenzaA__ADB89561

SEQ ID NO: 156575 - RNA, 1701 nt, Artificial Sequence; identical to SEQ ID NO: 155189
  derived and/or modified sequence opt4 from hemagglutinin__InfluenzaA__ADB89571

SEQ ID NO: 156576 - RNA, 1701 nt, Artificial Sequence; identical to SEQ ID NO: 155189
  derived and/or modified sequence opt4 from hemagglutinin__InfluenzaA__ADB89581

SEQ ID NO: 156577 - RNA, 1701 nt, Artificial Sequence
  derived and/or modified sequence opt4 from hemagglutinin__InfluenzaA__ADB89591
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacugggcccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156578 - RNA, 1701 nt, Artificial Sequence
  derived and/or modified sequence opt4 from hemagglutinin__InfluenzaA__ADB89601
augaaggccaucaucguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccugaccaucuacagcaccguggccagcagccuggugcugguggugagccugggcgccaucagcuucuggaugugcagcaacggcagccugcagugcagaaucugcaucuga

SEQ ID NO: 156579 - RNA, 1701 nt, Artificial Sequence; identical to SEQ ID NO: 156353
  derived and/or modified sequence opt4 from hemagglutinin__InfluenzaA__ADB89611

SEQ ID NO: 156580 - RNA, 1701 nt, Artificial Sequence; identical to SEQ ID NO: 156353
  derived and/or modified sequence opt4 from hemagglutinin__InfluenzaA__ADB89621

SEQ ID NO: 156581 - RNA, 1701 nt, Artificial Sequence
  derived and/or modified sequence opt4 from hemagglutinin__InfluenzaA__ADB89631
augaaggccauccugaucgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156582 - RNA, 1701 nt, Artificial Sequence; identical to SEQ ID NO: 156353
  derived and/or modified sequence opt4 from hemagglutinin__InfluenzaA__ADB89641

SEQ ID NO: 156583 - RNA, 1701 nt, Artificial Sequence; identical to SEQ ID NO: 155189
  derived and/or modified sequence opt4 from hemagglutinin__InfluenzaA__ADB89651

SEQ ID NO: 156584 - RNA, 1701 nt, Artificial Sequence; identical to SEQ ID NO: 155189
  derived and/or modified sequence opt4 from hemagglutinin__InfluenzaA__ADB89661

SEQ ID NO: 156585 - RNA, 1701 nt, Artificial Sequence; identical to SEQ ID NO: 156353
  derived and/or modified sequence opt4 from hemagglutinin__InfluenzaA__ADB89671

SEQ ID NO: 156586 - RNA, 1701 nt, Artificial Sequence; identical to SEQ ID NO: 155189
  derived and/or modified sequence opt4 from hemagglutinin__InfluenzaA__ADB89681

SEQ ID NO: 156587 - RNA, 1701 nt, Artificial Sequence; identical to SEQ ID NO: 155189
  derived and/or modified sequence opt4 from hemagglutinin__InfluenzaA__ADB89691

SEQ ID NO: 156588 - RNA, 1701 nt, Artificial Sequence; identical to SEQ ID NO: 156291
  derived and/or modified sequence opt4 from hemagglutinin__InfluenzaA__ADB89701

SEQ ID NO: 156589 - RNA, 1701 nt, Artificial Sequence
  derived and/or modified sequence opt4 from hemagglutinin__InfluenzaA__ADB89711
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuaccacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156590 - RNA, 1701 nt, Artificial Sequence
  derived and/or modified sequence opt4 from hemagglutinin__InfluenzaA__ADB89721
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucgacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguaccuguggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 156591 - RNA, 1701 nt, Artificial Sequence
  derived and/or modified sequence opt4 from hemagglutinin__InfluenzaA__ADB90360
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcaacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156592 - RNA, 1701 nt, Artificial Sequence
  derived and/or modified sequence opt4 from hemagglutinin__InfluenzaA__ADB90370
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156593 - RNA, 1701 nt, Artificial Sequence; identical to SEQ ID NO: 156108
  derived and/or modified sequence opt4 from hemagglutinin__InfluenzaA__ADB90414

SEQ ID NO: 156594 - RNA, 1701 nt, Artificial Sequence; identical to SEQ ID NO: 155636
  derived and/or modified sequence opt4 from hemagglutinin__InfluenzaA__ADC32409

SEQ ID NO: 156595 - RNA, 1701 nt, Artificial Sequence
  derived and/or modified sequence opt4 from hemagglutinin__InfluenzaA__ADC32410
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagaagacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156596 - RNA, 1701 nt, Artificial Sequence
  derived and/or modified sequence opt4 from hemagglutinin__InfluenzaA__ADC32411
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggccaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156597 - RNA, 1701 nt, Artificial Sequence; identical to SEQ ID NO: 155542
  derived and/or modified sequence opt4 from hemagglutinin__InfluenzaA__ADC32412

SEQ ID NO: 156598 - RNA, 1701 nt, Artificial Sequence; identical to SEQ ID NO: 155189
  derived and/or modified sequence opt4 from hemagglutinin__InfluenzaA__ADC32413

SEQ ID NO: 156599 - RNA, 1701 nt, Artificial Sequence; identical to SEQ ID NO: 155636
  derived and/or modified sequence opt4 from hemagglutinin__InfluenzaA__ADC32414

SEQ ID NO: 156600 - RNA, 1701 nt, Artificial Sequence; identical to SEQ ID NO: 155636
  derived and/or modified sequence opt4 from hemagglutinin__InfluenzaA__ADC32415

SEQ ID NO: 156601 - RNA, 1701 nt, Artificial Sequence; identical to SEQ ID NO: 155636
  derived and/or modified sequence opt4 from hemagglutinin__InfluenzaA__ADC32416

SEQ ID NO: 156602 - RNA, 1701 nt, Artificial Sequence
  derived and/or modified sequence opt4 from hemagglutinin__InfluenzaA__ADC32417
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaguacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcaacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156603 - RNA, 1701 nt, Artificial Sequence; identical to SEQ ID NO: 155636
  derived and/or modified sequence opt4 from hemagglutinin__InfluenzaA__ADC32418

SEQ ID NO: 156604 - RNA, 1701 nt, Artificial Sequence
  derived and/or modified sequence opt4 from hemagglutinin__InfluenzaA__ADC32419
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguucggcuaccaccaccagaacgaccagggcagcgccuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156605 - RNA, 1701 nt, Artificial Sequence; identical to SEQ ID NO: 155636
  derived and/or modified sequence opt4 from hemagglutinin__InfluenzaA__ADC32420

SEQ ID NO: 156606 - RNA, 1701 nt, Artificial Sequence; identical to SEQ ID NO: 155636
  derived and/or modified sequence opt4 from hemagglutinin__InfluenzaA__ADC32421

SEQ ID NO: 156607 - RNA, 1701 nt, Artificial Sequence
  derived and/or modified sequence opt4 from hemagglutinin__InfluenzaA__ADC32422
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugauggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156608 - RNA, 1701 nt, Artificial Sequence
  derived and/or modified sequence opt4 from hemagglutinin__InfluenzaA__ADC32423
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaaggugaacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156609 - RNA, 1701 nt, Artificial Sequence
  derived and/or modified sequence opt4 from hemagglutinin__InfluenzaA__ADC32434
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156610 - RNA, 1701 nt, Artificial Sequence; identical to SEQ ID NO: 156609
  derived and/or modified sequence opt4 from hemagglutinin__InfluenzaA__ADC32435

SEQ ID NO: 156611 - RNA, 1701 nt, Artificial Sequence
  derived and/or modified sequence opt4 from hemagglutinin__InfluenzaA__ADC34940
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagauucaacuggaccggcgugacccagaacggcaccagcagcgccugcaagagaggcagcgacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccugcacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugaagagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 156612 - RNA, 1701 nt, Artificial Sequence; identical to SEQ ID NO: 156524
  derived and/or modified sequence opt4 from hemagglutinin__InfluenzaA__ADC38987

SEQ ID NO: 156613 - RNA, 1701 nt, Artificial Sequence
  derived and/or modified sequence opt4 from hemagglutinin__InfluenzaA__ADC38997
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggacgugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156614 - RNA, 1701 nt, Artificial Sequence; identical to SEQ ID NO: 156290
  derived and/or modified sequence opt4 from hemagglutinin__InfluenzaA__ADC39007

SEQ ID NO: 156615 - RNA, 1698 nt, Artificial Sequence
  derived and/or modified sequence opt4 from hemagglutinin__InfluenzaA__ADC45604
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggccugggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156616 - RNA, 1698 nt, Artificial Sequence
  derived and/or modified sequence opt4 from hemagglutinin__InfluenzaA__ADC45626
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcaaccagaugacccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccagcggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156617 - RNA, 1698 nt, Artificial Sequence
  derived and/or modified sequence opt4 from hemagglutinin__InfluenzaA__ADC45637
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaugacccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccagcggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156618 - RNA, 1698 nt, Artificial Sequence
  derived and/or modified sequence opt4 from hemagglutinin__InfluenzaA__ADC45648
augaaggugaagcugcuggugcugcugugcaccuucgccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcaucgccggcugggugcugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156619 - RNA, 1698 nt, Artificial Sequence
  derived and/or modified sequence opt4 from hemagglutinin__InfluenzaA__ADC45659
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaagaagagcagcuggcccaaccacaccgugaccggcgugagcgccagcugcagccacaacggcgagagcagcuucuacagaaaccugcuguggcugaccgagaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156620 - RNA, 1698 nt, Artificial Sequence
  derived and/or modified sequence opt4 from hemagglutinin__InfluenzaA__ADC45670
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcggcagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156621 - RNA, 1698 nt, Artificial Sequence
  derived and/or modified sequence opt4 from hemagglutinin__InfluenzaA__ADC45681
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgccagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagaaagagcuacgccaacaacaaggagaaggaggugcuggugcuguggggcgugcaccacccccccaacaucggcgaccagaugacccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccagcggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156622 - RNA, 1698 nt, Artificial Sequence
  derived and/or modified sequence opt4 from hemagglutinin__InfluenzaA__ADC45692
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaagaagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156623 - RNA, 1698 nt, Artificial Sequence; identical to SEQ ID NO: 155690
  derived and/or modified sequence opt4 from hemagglutinin__InfluenzaA__ADC45703

SEQ ID NO: 156624 - RNA, 1698 nt, Artificial Sequence
  derived and/or modified sequence opt4 from hemagglutinin__InfluenzaA__ADC45714
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacaaccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaccacccuguaccacaaggagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccagcggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacguguggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugagcagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156625 - RNA, 1698 nt, Artificial Sequence; identical to SEQ ID NO: 155690
  derived and/or modified sequence opt4 from hemagglutinin__InfluenzaA__ADC45725

SEQ ID NO: 156626 - RNA, 1698 nt, Artificial Sequence
  derived and/or modified sequence opt4 from hemagglutinin__InfluenzaA__ADC45736
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacaccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156627 - RNA, 1698 nt, Artificial Sequence; identical to SEQ ID NO: 155008
  derived and/or modified sequence opt4 from hemagglutinin__InfluenzaA__ADC45747

SEQ ID NO: 156628 - RNA, 1698 nt, Artificial Sequence
  derived and/or modified sequence opt4 from hemagglutinin__InfluenzaA__ADC45758
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccugaacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156629 - RNA, 1698 nt, Artificial Sequence; identical to SEQ ID NO: 156146
  derived and/or modified sequence opt4 from hemagglutinin__InfluenzaA__ADC45780

SEQ ID NO: 156630 - RNA, 1698 nt, Artificial Sequence; identical to SEQ ID NO: 155651
  derived and/or modified sequence opt4 from hemagglutinin__InfluenzaA__ADC45791

SEQ ID NO: 156631 - RNA, 1698 nt, Artificial Sequence
  derived and/or modified sequence opt4 from hemagglutinin__InfluenzaA__ADC45813
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccaugaagaacggccuguaccccaaccugagcaagagcuacgccaacaacaaggagaaggaggugcuggugcuguggggcgugcaccacccccccaacaucggcgaccagaagacccuguacaacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156632 - RNA, 1698 nt, Artificial Sequence; identical to SEQ ID NO: 155651
  derived and/or modified sequence opt4 from hemagglutinin__InfluenzaA__ADC45824

SEQ ID NO: 156633 - RNA, 1698 nt, Artificial Sequence
  derived and/or modified sequence opt4 from hemagglutinin__InfluenzaA__ADC45835
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcuggugcuguggggcgugcaccacccccccaacaucgccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugacccuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156634 - RNA, 1698 nt, Artificial Sequence; identical to SEQ ID NO: 155008
  derived and/or modified sequence opt4 from hemagglutinin__InfluenzaA__ADC45846

SEQ ID NO: 156635 - RNA, 1701 nt, Artificial Sequence; identical to SEQ ID NO: 155189
  derived and/or modified sequence opt4 from hemagglutinin__InfluenzaA__ADC53558

SEQ ID NO: 156636 - RNA, 1701 nt, Artificial Sequence; identical to SEQ ID NO: 155280
  derived and/or modified sequence opt4 from hemagglutinin__InfluenzaA__ADD14087

SEQ ID NO: 156637 - RNA, 1701 nt, Artificial Sequence; identical to SEQ ID NO: 155189
  derived and/or modified sequence opt4 from hemagglutinin__InfluenzaA__ADD14089

SEQ ID NO: 156638 - RNA, 1701 nt, Artificial Sequence; identical to SEQ ID NO: 155189
  derived and/or modified sequence opt4 from hemagglutinin__InfluenzaA__ADD14093

SEQ ID NO: 156639 - RNA, 1701 nt, Artificial Sequence
  derived and/or modified sequence opt4 from hemagglutinin__InfluenzaA__ADD14095
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccuggugcugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156640 - RNA, 1701 nt, Artificial Sequence; identical to SEQ ID NO: 155189
  derived and/or modified sequence opt4 from hemagglutinin__InfluenzaA__ADD14097

SEQ ID NO: 156641 - RNA, 1701 nt, Artificial Sequence; identical to SEQ ID NO: 155189
  derived and/or modified sequence opt4 from hemagglutinin__InfluenzaA__ADD14099

SEQ ID NO: 156642 - RNA, 1701 nt, Artificial Sequence; identical to SEQ ID NO: 155189
  derived and/or modified sequence opt4 from hemagglutinin__InfluenzaA__ADD14101

SEQ ID NO: 156643 - RNA, 1701 nt, Artificial Sequence
  derived and/or modified sequence opt4 from hemagglutinin__InfluenzaA__ADD14103
augaaggccauccugguggugcugcugugcaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggacaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156644 - RNA, 1701 nt, Artificial Sequence
  derived and/or modified sequence opt4 from hemagglutinin__InfluenzaA__ADD14111
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaucagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156645 - RNA, 1701 nt, Artificial Sequence; identical to SEQ ID NO: 155189
  derived and/or modified sequence opt4 from hemagglutinin__InfluenzaA__ADD14115

SEQ ID NO: 156646 - RNA, 1701 nt, Artificial Sequence; identical to SEQ ID NO: 155189
  derived and/or modified sequence opt4 from hemagglutinin__InfluenzaA__ADD14117

SEQ ID NO: 156647 - RNA, 1701 nt, Artificial Sequence; identical to SEQ ID NO: 155189
  derived and/or modified sequence opt4 from hemagglutinin__InfluenzaA__ADD14119

SEQ ID NO: 156648 - RNA, 1701 nt, Artificial Sequence; identical to SEQ ID NO: 155189
  derived and/or modified sequence opt4 from hemagglutinin__InfluenzaA__ADD14121

SEQ ID NO: 156649 - RNA, 1701 nt, Artificial Sequence; identical to SEQ ID NO: 155189
  derived and/or modified sequence opt4 from hemagglutinin__InfluenzaA__ADD14123

SEQ ID NO: 156650 - RNA, 1701 nt, Artificial Sequence; identical to SEQ ID NO: 155189
  derived and/or modified sequence opt4 from hemagglutinin__InfluenzaA__ADD14127

SEQ ID NO: 156651 - RNA, 1701 nt, Artificial Sequence
  derived and/or modified sequence opt4 from hemagglutinin__InfluenzaA__ADD14129
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccagccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156652 - RNA, 1701 nt, Artificial Sequence
  derived and/or modified sequence opt4 from hemagglutinin__InfluenzaA__ADD14133
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacguggacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcuucggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156653 - RNA, 1701 nt, Artificial Sequence; identical to SEQ ID NO: 155280
  derived and/or modified sequence opt4 from hemagglutinin__InfluenzaA__ADD14135

SEQ ID NO: 156654 - RNA, 1701 nt, Artificial Sequence; identical to SEQ ID NO: 155189
  derived and/or modified sequence opt4 from hemagglutinin__InfluenzaA__ADD14137

SEQ ID NO: 156655 - RNA, 1701 nt, Artificial Sequence; identical to SEQ ID NO: 155937
  derived and/or modified sequence opt4 from hemagglutinin__InfluenzaA__ADD14139

SEQ ID NO: 156656 - RNA, 1701 nt, Artificial Sequence; identical to SEQ ID NO: 155189
  derived and/or modified sequence opt4 from hemagglutinin__InfluenzaA__ADD14143

SEQ ID NO: 156657 - RNA, 1701 nt, Artificial Sequence; identical to SEQ ID NO: 155189
  derived and/or modified sequence opt4 from hemagglutinin__InfluenzaA__ADD14145

SEQ ID NO: 156658 - RNA, 1701 nt, Artificial Sequence; identical to SEQ ID NO: 155189
  derived and/or modified sequence opt4 from hemagglutinin__InfluenzaA__ADD14147

SEQ ID NO: 156659 - RNA, 1701 nt, Artificial Sequence
  derived and/or modified sequence opt4 from hemagglutinin__InfluenzaA__ADD14151
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugccccagagccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156660 - RNA, 1701 nt, Artificial Sequence; identical to SEQ ID NO: 155189
  derived and/or modified sequence opt4 from hemagglutinin__InfluenzaA__ADD14153

SEQ ID NO: 156661 - RNA, 1701 nt, Artificial Sequence; identical to SEQ ID NO: 155189
  derived and/or modified sequence opt4 from hemagglutinin__InfluenzaA__ADD14155

SEQ ID NO: 156662 - RNA, 1701 nt, Artificial Sequence; identical to SEQ ID NO: 155189
  derived and/or modified sequence opt4 from hemagglutinin__InfluenzaA__ADD14157

SEQ ID NO: 156663 - RNA, 1701 nt, Artificial Sequence; identical to SEQ ID NO: 155189
  derived and/or modified sequence opt4 from hemagglutinin__InfluenzaA__ADD14162

SEQ ID NO: 156664 - RNA, 1701 nt, Artificial Sequence; identical to SEQ ID NO: 155189
  derived and/or modified sequence opt4 from hemagglutinin__InfluenzaA__ADD14172

SEQ ID NO: 156665 - RNA, 1701 nt, Artificial Sequence; identical to SEQ ID NO: 155189
  derived and/or modified sequence opt4 from hemagglutinin__InfluenzaA__ADD14182

SEQ ID NO: 156666 - RNA, 1701 nt, Artificial Sequence; identical to SEQ ID NO: 155189
  derived and/or modified sequence opt4 from hemagglutinin__InfluenzaA__ADD14192

SEQ ID NO: 156667 - RNA, 1701 nt, Artificial Sequence; identical to SEQ ID NO: 155189
  derived and/or modified sequence opt4 from hemagglutinin__InfluenzaA__ADD14202

SEQ ID NO: 156668 - RNA, 1701 nt, Artificial Sequence
  derived and/or modified sequence opt4 from hemagglutinin__InfluenzaA__ADD21447
augaaggccauccugguguuccugcuguacaccuucgccaccgccaacgccgacacccugugcaucggcuaccacgccaacaacagcaccgacaccguggacaccgugcuggagaagaacgugaccgugacccacagcgugaaccugcuggaggacagacacaacggcaagcugugcaagcugagaggcguggccccccugcaccugggcaagugcaacaucgccggcuggcugcugggcaaccccgagugcgagcugcuguucaccgccagcagcuggagcuacaucguggagaccagcaacagcgacaacggcaccugcuaccccggcgacuucaucaacuacgaggagcugagagagcagcugagcagcgugagcagcuucgagagauucgagauguuccccaagagcagcagcuggcccaaccacgagaccaacagaggcgugaccgccgccugccccuacgccggcgccaacagcuucuacagaaaccugaucuggcuggugaagaaggagaacagcuaccccaagcugagcaagagcuacaucaacaacaaggagaaggaggugcuggugcuguggggcauccaccacccccccaccagcgccgaccagcagagccuguaccagaacgccgacgccuacguguucgugggcagcagcaaguacaacaagaaguucagacccgagaucgccgccagacccaaggugagaggccagaccggcagaaugaacuacuacuggacccugguggagcccggcgacaccaucaccuucgaggccaccgagaaccugguggugcccagauacgccuucgccaugaagagaggcagcggcagcggcaucaucaucagcgacacccccgugcacgacugcaacaccaccugccagacccccaagggcgccaucaacaccagccugcccuuccagaacauccaccccgugaccaucggcgagugccccaaguacgugaagagcaccaaccugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacagaaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggccugcuggacguguggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaccugcauggagagcgugagaaacggcgccuacgacuaccccaaguacagcgaggaggccaagcugaacagagaggagaucgacggcgugaagcuggagagcaccagaaucuaccagauccuggccaucuacagcaccguggccagcagccuggugcugcuggugagccugggcgccaucagcuucuggaugugcagcaacggcagccugcagugcagaaucugcaucuga

SEQ ID NO: 156669 - RNA, 1701 nt, Artificial Sequence
  derived and/or modified sequence opt4 from hemagglutinin__InfluenzaA__ADD21457
augaaggccauccugguguuccugcuguacaccuucgccaccgccaacgccgacacccugugcaucggcuaccacgccaacaacagcaccgacaccguggacaccgugcuggagaagaacgugaccgugacccacagcgugaaccugcuggaggacagacacaacggcaagcugugcaagcugagaggcguggccccccugcaccugggcaagugcaacaucgccggcuggcugcugggcaaccccgagugcgagcugcuguucaccgccagcagcuggagcuacaucguggagaccagcaacagcgacaacggcaccugcuaccccggcgacuucaucaacuacgaggagcugagagagcagcugagcagcgugagcagcuucgagagauucgagauguuccccaagagcagcagcuggcccaaccacgagaccaacagaggcgugaccgccgccugccccuacgccggcgccaacagcuucuacagaaaccugaucuggcuggugaagaaggagaacagcuaccccaagcugagcaagagcuacaucaacaacaaggagaaggaggugcuggugcuguggggcauccaccacccccccaccagcgccgaccagcagagccuguaccagaacgccgacgccuacguguucgugggcagcagcaaguacaacaagaaguucagacccgagaucgccgccagacccaaggugagaggccagaccggcagaaugaacuacuacuggacccugguggagcccggcgacaccaucaccuucgaggccaccggcaaccugguggugcccagauacgccuucgccaugaagagaggcagcggcagcggcaucaucaucagcgacacccccgugcacgacugcaacaccaccugccagacccccaagggcgccgugaacaccagccugcccuuccagaacauccaccccgugaccaucggcgagugccccaaguacgugaagagcaccaaccugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacagaaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggccugcuggacguguggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaccugcauggagagcgugagaaacggcaccuacgacuaccccaaguacagcgaggaggccaagcugaacagagaggagaucgacggcgugaagcuggagagcaccagaaucuaccagauccuggccaucuacagcaccguggccagcagccuggugcugcuggugagccugggcgccaucagcuucuggaugugcagcaacggcagccugcagugcagaaucugcaucuga

SEQ ID NO: 156670 - RNA, 1698 nt, Artificial Sequence
  derived and/or modified sequence opt4 from hemagglutinin__InfluenzaA__ADD21467
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucagagaccagagagcccuguaccacaccgagaacgccuacgugagcguggugagcagccacuacagcagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgccagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 156671 - RNA, 1701 nt, Artificial Sequence
  derived and/or modified sequence opt4 from hemagglutinin__InfluenzaA__ADD21560
augaagaccaucaucgccuucagccacauccugugccugaucuacgcccagaagcugcccggcagcgacaacagcauggccacccugugccugggccaccacgccgugcccaacggcacccuggugaagaccaucaccgacgaccagaucgaggugaccaacgccaccgagcuggugcagagcagcagcaccggcagaaucugcaacagcccccaccacauccuggacggcaagaacugcacccugaucgacgcccugcugggcgacccccacugcgacgacuuccagaacaaggagugggaccuguucguggagagaagcaccgccuacagcaacugcuaccccuacuacgugcccgacuacgccagccugagaagccugguggccagcagcggcacccuggaguucacccaggagagcuucaacuggaccggcgugacccaggacggcagcagcuacaccugcagaagaaagagcgugaacagcuucuucagcagacugaacuggcugcacaaccuggacuacaaguaccccgcccugaacgugaccaugcccaacaacgacaaguucgacaagcuguacaucuggggcgugcaccaccccggcaccgacagagaccagaccaaccuguacgugcaggccagcggcagagugaccgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaccggcaagcugaacagagugaucaagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagagcgugcagcugaagagcggcuacaaggacuggauccuguggaucagcuucgccaugagcugcuuccugcugugcguggugcugcugggcuucaucauguggaccugccagaagggcaacaucaagugcaacaucugcaucuga

SEQ ID NO: 156672 - RNA, 1701 nt, Artificial Sequence; identical to SEQ ID NO: 155176
  derived and/or modified sequence opt4 from hemagglutinin__InfluenzaA__ADD21734

SEQ ID NO: 156673 - RNA, 1701 nt, Artificial Sequence; identical to SEQ ID NO: 155189
  derived and/or modified sequence opt4 from hemagglutinin__InfluenzaA__ADD21744

SEQ ID NO: 156674 - RNA, 1701 nt, Artificial Sequence
  derived and/or modified sequence opt4 from hemagglutinin__InfluenzaA__ADD21764
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccgagagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156675 - RNA, 1701 nt, Artificial Sequence
  derived and/or modified sequence opt4 from hemagglutinin__InfluenzaA__ADD21774
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcgugcagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156676 - RNA, 1701 nt, Artificial Sequence; identical to SEQ ID NO: 155189
  derived and/or modified sequence opt4 from hemagglutinin__InfluenzaA__ADD21784

SEQ ID NO: 156677 - RNA, 1701 nt, Artificial Sequence; identical to SEQ ID NO: 156349
  derived and/or modified sequence opt4 from hemagglutinin__InfluenzaA__ADD21794

SEQ ID NO: 156678 - RNA, 1701 nt, Artificial Sequence; identical to SEQ ID NO: 155189
  derived and/or modified sequence opt4 from hemagglutinin__InfluenzaA__ADD21804

SEQ ID NO: 156679 - RNA, 1701 nt, Artificial Sequence
  derived and/or modified sequence opt4 from hemagglutinin__InfluenzaA__ADD21814
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccagcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156680 - RNA, 1701 nt, Artificial Sequence; identical to SEQ ID NO: 156349
  derived and/or modified sequence opt4 from hemagglutinin__InfluenzaA__ADD21824

SEQ ID NO: 156681 - RNA, 1701 nt, Artificial Sequence; identical to SEQ ID NO: 156349
  derived and/or modified sequence opt4 from hemagglutinin__InfluenzaA__ADD21834

SEQ ID NO: 156682 - RNA, 1701 nt, Artificial Sequence; identical to SEQ ID NO: 156353
  derived and/or modified sequence opt4 from hemagglutinin__InfluenzaA__ADD21844

SEQ ID NO: 156683 - RNA, 1701 nt, Artificial Sequence; identical to SEQ ID NO: 156353
  derived and/or modified sequence opt4 from hemagglutinin__InfluenzaA__ADD21854

SEQ ID NO: 156684 - RNA, 1701 nt, Artificial Sequence; identical to SEQ ID NO: 156291
  derived and/or modified sequence opt4 from hemagglutinin__InfluenzaA__ADD21864

SEQ ID NO: 156685 - RNA, 1701 nt, Artificial Sequence
  derived and/or modified sequence opt4 from hemagglutinin__InfluenzaA__ADD21884
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcaugggcagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156686 - RNA, 1701 nt, Artificial Sequence; identical to SEQ ID NO: 156291
  derived and/or modified sequence opt4 from hemagglutinin__InfluenzaA__ADD21894

SEQ ID NO: 156687 - RNA, 1701 nt, Artificial Sequence
  derived and/or modified sequence opt4 from hemagglutinin__InfluenzaA__ADD22501
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaauccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156688 - RNA, 1701 nt, Artificial Sequence; identical to SEQ ID NO: 156291
  derived and/or modified sequence opt4 from hemagglutinin__InfluenzaA__ADD22511

SEQ ID NO: 156689 - RNA, 1701 nt, Artificial Sequence
  derived and/or modified sequence opt4 from hemagglutinin__InfluenzaA__ADD22521
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156690 - RNA, 1701 nt, Artificial Sequence; identical to SEQ ID NO: 155189
  derived and/or modified sequence opt4 from hemagglutinin__InfluenzaA__ADD22531

SEQ ID NO: 156691 - RNA, 1701 nt, Artificial Sequence
  derived and/or modified sequence opt4 from hemagglutinin__InfluenzaA__ADD22541
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156692 - RNA, 1701 nt, Artificial Sequence; identical to SEQ ID NO: 156291
  derived and/or modified sequence opt4 from hemagglutinin__InfluenzaA__ADD22554

SEQ ID NO: 156693 - RNA, 1701 nt, Artificial Sequence; identical to SEQ ID NO: 156291
  derived and/or modified sequence opt4 from hemagglutinin__InfluenzaA__ADD22564

SEQ ID NO: 156694 - RNA, 1701 nt, Artificial Sequence
  derived and/or modified sequence opt4 from hemagglutinin__InfluenzaA__ADD22574
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccugaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156695 - RNA, 1701 nt, Artificial Sequence; identical to SEQ ID NO: 156291
  derived and/or modified sequence opt4 from hemagglutinin__InfluenzaA__ADD22584

SEQ ID NO: 156696 - RNA, 1701 nt, Artificial Sequence; identical to SEQ ID NO: 155189
  derived and/or modified sequence opt4 from hemagglutinin__InfluenzaA__ADD22594

SEQ ID NO: 156697 - RNA, 1701 nt, Artificial Sequence; identical to SEQ ID NO: 156291
  derived and/or modified sequence opt4 from hemagglutinin__InfluenzaA__ADD22604

SEQ ID NO: 156698 - RNA, 1701 nt, Artificial Sequence; identical to SEQ ID NO: 156291
  derived and/or modified sequence opt4 from hemagglutinin__InfluenzaA__ADD22614

SEQ ID NO: 156699 - RNA, 1701 nt, Artificial Sequence; identical to SEQ ID NO: 156291
  derived and/or modified sequence opt4 from hemagglutinin__InfluenzaA__ADD22624

SEQ ID NO: 156700 - RNA, 1701 nt, Artificial Sequence
  derived and/or modified sequence opt4 from hemagglutinin__InfluenzaA__ADD22634
augaaggccauccugguggugcugcugugcaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156701 - RNA, 1701 nt, Artificial Sequence
  derived and/or modified sequence opt4 from hemagglutinin__InfluenzaA__ADD22645
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgagggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156702 - RNA, 1701 nt, Artificial Sequence
  derived and/or modified sequence opt4 from hemagglutinin__InfluenzaA__ADD22665
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagagaaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156703 - RNA, 1701 nt, Artificial Sequence; identical to SEQ ID NO: 156291
  derived and/or modified sequence opt4 from hemagglutinin__InfluenzaA__ADD22675

SEQ ID NO: 156704 - RNA, 1701 nt, Artificial Sequence; identical to SEQ ID NO: 156291
  derived and/or modified sequence opt4 from hemagglutinin__InfluenzaA__ADD22685

SEQ ID NO: 156705 - RNA, 1701 nt, Artificial Sequence; identical to SEQ ID NO: 156291
  derived and/or modified sequence opt4 from hemagglutinin__InfluenzaA__ADD22695

SEQ ID NO: 156706 - RNA, 1701 nt, Artificial Sequence
  derived and/or modified sequence opt4 from hemagglutinin__InfluenzaA__ADD22722
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacagacacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagcuacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156707 - RNA, 1701 nt, Artificial Sequence; identical to SEQ ID NO: 156689
  derived and/or modified sequence opt4 from hemagglutinin__InfluenzaA__ADD22732

SEQ ID NO: 156708 - RNA, 1701 nt, Artificial Sequence
  derived and/or modified sequence opt4 from hemagglutinin__InfluenzaA__ADD22742
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagcuacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156709 - RNA, 1701 nt, Artificial Sequence; identical to SEQ ID NO: 155189
  derived and/or modified sequence opt4 from hemagglutinin__InfluenzaA__ADD22752

SEQ ID NO: 156710 - RNA, 1701 nt, Artificial Sequence; identical to SEQ ID NO: 155280
  derived and/or modified sequence opt4 from hemagglutinin__InfluenzaA__ADD22762

SEQ ID NO: 156711 - RNA, 1701 nt, Artificial Sequence; identical to SEQ ID NO: 156291
  derived and/or modified sequence opt4 from hemagglutinin__InfluenzaA__ADD22772

SEQ ID NO: 156712 - RNA, 1701 nt, Artificial Sequence; identical to SEQ ID NO: 156291
  derived and/or modified sequence opt4 from hemagglutinin__InfluenzaA__ADD22782

SEQ ID NO: 156713 - RNA, 1701 nt, Artificial Sequence
  derived and/or modified sequence opt4 from hemagglutinin__InfluenzaA__ADD22792
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156714 - RNA, 1701 nt, Artificial Sequence; identical to SEQ ID NO: 156689
  derived and/or modified sequence opt4 from hemagglutinin__InfluenzaA__ADD22802

SEQ ID NO: 156715 - RNA, 1701 nt, Artificial Sequence; identical to SEQ ID NO: 156291
  derived and/or modified sequence opt4 from hemagglutinin__InfluenzaA__ADD22812

SEQ ID NO: 156716 - RNA, 1701 nt, Artificial Sequence
  derived and/or modified sequence opt4 from hemagglutinin__InfluenzaA__ADD22822
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcgccgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaugugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156717 - RNA, 1701 nt, Artificial Sequence; identical to SEQ ID NO: 156291
  derived and/or modified sequence opt4 from hemagglutinin__InfluenzaA__ADD22832

SEQ ID NO: 156718 - RNA, 1701 nt, Artificial Sequence; identical to SEQ ID NO: 156291
  derived and/or modified sequence opt4 from hemagglutinin__InfluenzaA__ADD22842

SEQ ID NO: 156719 - RNA, 1701 nt, Artificial Sequence
  derived and/or modified sequence opt4 from hemagglutinin__InfluenzaA__ADD22852
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucgugaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156720 - RNA, 1701 nt, Artificial Sequence
  derived and/or modified sequence opt4 from hemagglutinin__InfluenzaA__ADD22941
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccaucagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156721 - RNA, 1701 nt, Artificial Sequence; identical to SEQ ID NO: 156291
  derived and/or modified sequence opt4 from hemagglutinin__InfluenzaA__ADD22951

SEQ ID NO: 156722 - RNA, 1701 nt, Artificial Sequence; identical to SEQ ID NO: 156291
  derived and/or modified sequence opt4 from hemagglutinin__InfluenzaA__ADD22961

SEQ ID NO: 156723 - RNA, 1701 nt, Artificial Sequence; identical to SEQ ID NO: 156291
  derived and/or modified sequence opt4 from hemagglutinin__InfluenzaA__ADD22971

SEQ ID NO: 156724 - RNA, 1701 nt, Artificial Sequence; identical to SEQ ID NO: 156291
  derived and/or modified sequence opt4 from hemagglutinin__InfluenzaA__ADD23072

SEQ ID NO: 156725 - RNA, 1701 nt, Artificial Sequence
  derived and/or modified sequence opt4 from hemagglutinin__InfluenzaA__ADD23082
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156726 - RNA, 1701 nt, Artificial Sequence
  derived and/or modified sequence opt4 from hemagglutinin__InfluenzaA__ADD23102
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagaaguucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156727 - RNA, 1701 nt, Artificial Sequence; identical to SEQ ID NO: 156291
  derived and/or modified sequence opt4 from hemagglutinin__InfluenzaA__ADD23112

SEQ ID NO: 156728 - RNA, 1701 nt, Artificial Sequence; identical to SEQ ID NO: 156291
  derived and/or modified sequence opt4 from hemagglutinin__InfluenzaA__ADD23122

SEQ ID NO: 156729 - RNA, 1701 nt, Artificial Sequence; identical to SEQ ID NO: 155189
  derived and/or modified sequence opt4 from hemagglutinin__InfluenzaA__ADD23132

SEQ ID NO: 156730 - RNA, 1701 nt, Artificial Sequence; identical to SEQ ID NO: 156353
  derived and/or modified sequence opt4 from hemagglutinin__InfluenzaA__ADD23142

SEQ ID NO: 156731 - RNA, 1701 nt, Artificial Sequence
  derived and/or modified sequence opt4 from hemagglutinin__InfluenzaA__ADD23162
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagggccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156732 - RNA, 1701 nt, Artificial Sequence; identical to SEQ ID NO: 156353
  derived and/or modified sequence opt4 from hemagglutinin__InfluenzaA__ADD23172

SEQ ID NO: 156733 - RNA, 1701 nt, Artificial Sequence; identical to SEQ ID NO: 156353
  derived and/or modified sequence opt4 from hemagglutinin__InfluenzaA__ADD23182

SEQ ID NO: 156734 - RNA, 1701 nt, Artificial Sequence; identical to SEQ ID NO: 156353
  derived and/or modified sequence opt4 from hemagglutinin__InfluenzaA__ADD23192

SEQ ID NO: 156735 - RNA, 1701 nt, Artificial Sequence; identical to SEQ ID NO: 156353
  derived and/or modified sequence opt4 from hemagglutinin__InfluenzaA__ADD23202

SEQ ID NO: 156736 - RNA, 1701 nt, Artificial Sequence; identical to SEQ ID NO: 156353
  derived and/or modified sequence opt4 from hemagglutinin__InfluenzaA__ADD23220

SEQ ID NO: 156737 - RNA, 1701 nt, Artificial Sequence; identical to SEQ ID NO: 156349
  derived and/or modified sequence opt4 from hemagglutinin__InfluenzaA__ADD23230

SEQ ID NO: 156738 - RNA, 1701 nt, Artificial Sequence; identical to SEQ ID NO: 156353
  derived and/or modified sequence opt4 from hemagglutinin__InfluenzaA__ADD23240

SEQ ID NO: 156739 - RNA, 1701 nt, Artificial Sequence
  derived and/or modified sequence opt4 from hemagglutinin__InfluenzaA__ADD23260
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156740 - RNA, 1701 nt, Artificial Sequence; identical to SEQ ID NO: 155542
  derived and/or modified sequence opt4 from hemagglutinin__InfluenzaA__ADD23280

SEQ ID NO: 156741 - RNA, 1701 nt, Artificial Sequence
  derived and/or modified sequence opt4 from hemagglutinin__InfluenzaA__ADD23290
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156742 - RNA, 1701 nt, Artificial Sequence; identical to SEQ ID NO: 156353
  derived and/or modified sequence opt4 from hemagglutinin__InfluenzaA__ADD23300

SEQ ID NO: 156743 - RNA, 1701 nt, Artificial Sequence; identical to SEQ ID NO: 156741
  derived and/or modified sequence opt4 from hemagglutinin__InfluenzaA__ADD23310

SEQ ID NO: 156744 - RNA, 1701 nt, Artificial Sequence; identical to SEQ ID NO: 156353
  derived and/or modified sequence opt4 from hemagglutinin__InfluenzaA__ADD23320

SEQ ID NO: 156745 - RNA, 1701 nt, Artificial Sequence
  derived and/or modified sequence opt4 from hemagglutinin__InfluenzaA__ADD23330
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaccaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156746 - RNA, 1701 nt, Artificial Sequence
  derived and/or modified sequence opt4 from hemagglutinin__InfluenzaA__ADD23355
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagauguucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156747 - RNA, 1701 nt, Artificial Sequence; identical to SEQ ID NO: 156741
  derived and/or modified sequence opt4 from hemagglutinin__InfluenzaA__ADD23375

SEQ ID NO: 156748 - RNA, 1701 nt, Artificial Sequence; identical to SEQ ID NO: 156353
  derived and/or modified sequence opt4 from hemagglutinin__InfluenzaA__ADD23385

SEQ ID NO: 156749 - RNA, 1701 nt, Artificial Sequence
  derived and/or modified sequence opt4 from hemagglutinin__InfluenzaA__ADD23405
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccgugggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156750 - RNA, 1701 nt, Artificial Sequence
  derived and/or modified sequence opt4 from hemagglutinin__InfluenzaA__ADD23415
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccgagagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156751 - RNA, 1701 nt, Artificial Sequence; identical to SEQ ID NO: 156353
  derived and/or modified sequence opt4 from hemagglutinin__InfluenzaA__ADD23435

SEQ ID NO: 156752 - RNA, 1701 nt, Artificial Sequence
  derived and/or modified sequence opt4 from hemagglutinin__InfluenzaA__ADD23465
augaaggccauccuggccgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156753 - RNA, 1701 nt, Artificial Sequence; identical to SEQ ID NO: 156353
  derived and/or modified sequence opt4 from hemagglutinin__InfluenzaA__ADD23475

SEQ ID NO: 156754 - RNA, 1701 nt, Artificial Sequence; identical to SEQ ID NO: 156353
  derived and/or modified sequence opt4 from hemagglutinin__InfluenzaA__ADD23485

SEQ ID NO: 156755 - RNA, 1701 nt, Artificial Sequence
  derived and/or modified sequence opt4 from hemagglutinin__InfluenzaA__ADD23495
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccagaagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156756 - RNA, 1701 nt, Artificial Sequence
  derived and/or modified sequence opt4 from hemagglutinin__InfluenzaA__ADD23505
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156757 - RNA, 1701 nt, Artificial Sequence; identical to SEQ ID NO: 156353
  derived and/or modified sequence opt4 from hemagglutinin__InfluenzaA__ADD23515

SEQ ID NO: 156758 - RNA, 1701 nt, Artificial Sequence; identical to SEQ ID NO: 156353
  derived and/or modified sequence opt4 from hemagglutinin__InfluenzaA__ADD23994

SEQ ID NO: 156759 - RNA, 1701 nt, Artificial Sequence
  derived and/or modified sequence opt4 from hemagglutinin__InfluenzaA__ADD24004
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaacggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156760 - RNA, 1701 nt, Artificial Sequence; identical to SEQ ID NO: 156291
  derived and/or modified sequence opt4 from hemagglutinin__InfluenzaA__ADD24014

SEQ ID NO: 156761 - RNA, 1701 nt, Artificial Sequence
  derived and/or modified sequence opt4 from hemagglutinin__InfluenzaA__ADD52537
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156762 - RNA, 1701 nt, Artificial Sequence; identical to SEQ ID NO: 156353
  derived and/or modified sequence opt4 from hemagglutinin__InfluenzaA__ADD64203

SEQ ID NO: 156763 - RNA, 1701 nt, Artificial Sequence
  derived and/or modified sequence opt4 from hemagglutinin__InfluenzaA__ADD64204
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgagaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccagagagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156764 - RNA, 1701 nt, Artificial Sequence; identical to SEQ ID NO: 155189
  derived and/or modified sequence opt4 from hemagglutinin__InfluenzaA__ADD64205

SEQ ID NO: 156765 - RNA, 1701 nt, Artificial Sequence; identical to SEQ ID NO: 155189
  derived and/or modified sequence opt4 from hemagglutinin__InfluenzaA__ADD64206

SEQ ID NO: 156766 - RNA, 1701 nt, Artificial Sequence; identical to SEQ ID NO: 155987
  derived and/or modified sequence opt4 from hemagglutinin__InfluenzaA__ADD64207

SEQ ID NO: 156767 - RNA, 1701 nt, Artificial Sequence
  derived and/or modified sequence opt4 from hemagglutinin__InfluenzaA__ADD64208
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgaccccaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156768 - RNA, 1701 nt, Artificial Sequence; identical to SEQ ID NO: 155987
  derived and/or modified sequence opt4 from hemagglutinin__InfluenzaA__ADD64209

SEQ ID NO: 156769 - RNA, 1701 nt, Artificial Sequence; identical to SEQ ID NO: 155189
  derived and/or modified sequence opt4 from hemagglutinin__InfluenzaA__ADD64210

SEQ ID NO: 156770 - RNA, 1701 nt, Artificial Sequence; identical to SEQ ID NO: 155987
  derived and/or modified sequence opt4 from hemagglutinin__InfluenzaA__ADD64211

SEQ ID NO: 156771 - RNA, 1701 nt, Artificial Sequence; identical to SEQ ID NO: 155189
  derived and/or modified sequence opt4 from hemagglutinin__InfluenzaA__ADD64212

SEQ ID NO: 156772 - RNA, 1701 nt, Artificial Sequence; identical to SEQ ID NO: 155987
  derived and/or modified sequence opt4 from hemagglutinin__InfluenzaA__ADD64213

SEQ ID NO: 156773 - RNA, 1701 nt, Artificial Sequence
  derived and/or modified sequence opt4 from hemagglutinin__InfluenzaA__ADD64214
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggagaacaagcacaacggcaagcugugcaagcugagaggcguggccccccugcaccugggcaagugcaacaucgccggcuggauccugggcaaccccgagugcgagagcuucagcaccagcagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156774 - RNA, 1701 nt, Artificial Sequence; identical to SEQ ID NO: 155189
  derived and/or modified sequence opt4 from hemagglutinin__InfluenzaA__ADD64215

SEQ ID NO: 156775 - RNA, 1701 nt, Artificial Sequence; identical to SEQ ID NO: 155987
  derived and/or modified sequence opt4 from hemagglutinin__InfluenzaA__ADD64216

SEQ ID NO: 156776 - RNA, 1701 nt, Artificial Sequence; identical to SEQ ID NO: 155987
  derived and/or modified sequence opt4 from hemagglutinin__InfluenzaA__ADD64217

SEQ ID NO: 156777 - RNA, 1701 nt, Artificial Sequence
  derived and/or modified sequence opt4 from hemagglutinin__InfluenzaA__ADD74350
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcagccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156778 - RNA, 1701 nt, Artificial Sequence
  derived and/or modified sequence opt4 from hemagglutinin__InfluenzaA__ADD74360
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagagaaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156779 - RNA, 1701 nt, Artificial Sequence; identical to SEQ ID NO: 155189
  derived and/or modified sequence opt4 from hemagglutinin__InfluenzaA__ADD74370

SEQ ID NO: 156780 - RNA, 1701 nt, Artificial Sequence; identical to SEQ ID NO: 155189
  derived and/or modified sequence opt4 from hemagglutinin__InfluenzaA__ADD74398

SEQ ID NO: 156781 - RNA, 1701 nt, Artificial Sequence
  derived and/or modified sequence opt4 from hemagglutinin__InfluenzaA__ADD74428
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccuggugaagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156782 - RNA, 1701 nt, Artificial Sequence
  derived and/or modified sequence opt4 from hemagglutinin__InfluenzaA__ADD74438
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagcccaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156783 - RNA, 1701 nt, Artificial Sequence; identical to SEQ ID NO: 155189
  derived and/or modified sequence opt4 from hemagglutinin__InfluenzaA__ADD74448

SEQ ID NO: 156784 - RNA, 1701 nt, Artificial Sequence; identical to SEQ ID NO: 155189
  derived and/or modified sequence opt4 from hemagglutinin__InfluenzaA__ADD74458

SEQ ID NO: 156785 - RNA, 1701 nt, Artificial Sequence
  derived and/or modified sequence opt4 from hemagglutinin__InfluenzaA__ADD74468
augaaggccauccugguggugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucaccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156786 - RNA, 1701 nt, Artificial Sequence
  derived and/or modified sequence opt4 from hemagglutinin__InfluenzaA__ADD74488
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156787 - RNA, 1701 nt, Artificial Sequence; identical to SEQ ID NO: 155189
  derived and/or modified sequence opt4 from hemagglutinin__InfluenzaA__ADD74498

SEQ ID NO: 156788 - RNA, 1701 nt, Artificial Sequence
  derived and/or modified sequence opt4 from hemagglutinin__InfluenzaA__ADD74508
augaaggccauccugguggugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccgaggccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156789 - RNA, 1701 nt, Artificial Sequence
  derived and/or modified sequence opt4 from hemagglutinin__InfluenzaA__ADD74518
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggagauccuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacaccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156790 - RNA, 1701 nt, Artificial Sequence
  derived and/or modified sequence opt4 from hemagglutinin__InfluenzaA__ADD74528
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguuccagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156791 - RNA, 1701 nt, Artificial Sequence
  derived and/or modified sequence opt4 from hemagglutinin__InfluenzaA__ADD74538
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcagacugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccguguacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156792 - RNA, 1701 nt, Artificial Sequence; identical to SEQ ID NO: 156786
  derived and/or modified sequence opt4 from hemagglutinin__InfluenzaA__ADD74548

SEQ ID NO: 156793 - RNA, 1701 nt, Artificial Sequence; identical to SEQ ID NO: 156353
  derived and/or modified sequence opt4 from hemagglutinin__InfluenzaA__ADD74558

SEQ ID NO: 156794 - RNA, 1701 nt, Artificial Sequence; identical to SEQ ID NO: 156741
  derived and/or modified sequence opt4 from hemagglutinin__InfluenzaA__ADD74568

SEQ ID NO: 156795 - RNA, 1701 nt, Artificial Sequence
  derived and/or modified sequence opt4 from hemagglutinin__InfluenzaA__ADD74578
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccagcagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156796 - RNA, 1701 nt, Artificial Sequence
  derived and/or modified sequence opt4 from hemagglutinin__InfluenzaA__ADD74588
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgacggccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcaaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156797 - RNA, 1701 nt, Artificial Sequence; identical to SEQ ID NO: 156741
  derived and/or modified sequence opt4 from hemagglutinin__InfluenzaA__ADD74598

SEQ ID NO: 156798 - RNA, 1701 nt, Artificial Sequence; identical to SEQ ID NO: 156741
  derived and/or modified sequence opt4 from hemagglutinin__InfluenzaA__ADD74608

SEQ ID NO: 156799 - RNA, 1701 nt, Artificial Sequence; identical to SEQ ID NO: 156353
  derived and/or modified sequence opt4 from hemagglutinin__InfluenzaA__ADD74618

SEQ ID NO: 156800 - RNA, 1701 nt, Artificial Sequence
  derived and/or modified sequence opt4 from hemagglutinin__InfluenzaA__ADD74628
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggagauccuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagaagaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156801 - RNA, 1701 nt, Artificial Sequence; identical to SEQ ID NO: 156290
  derived and/or modified sequence opt4 from hemagglutinin__InfluenzaA__ADD74648

SEQ ID NO: 156802 - RNA, 1701 nt, Artificial Sequence
  derived and/or modified sequence opt4 from hemagglutinin__InfluenzaA__ADD74658
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacagcuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156803 - RNA, 1701 nt, Artificial Sequence; identical to SEQ ID NO: 156741
  derived and/or modified sequence opt4 from hemagglutinin__InfluenzaA__ADD74668

SEQ ID NO: 156804 - RNA, 1701 nt, Artificial Sequence; identical to SEQ ID NO: 156781
  derived and/or modified sequence opt4 from hemagglutinin__InfluenzaA__ADD74678

SEQ ID NO: 156805 - RNA, 1701 nt, Artificial Sequence; identical to SEQ ID NO: 156741
  derived and/or modified sequence opt4 from hemagglutinin__InfluenzaA__ADD74688

SEQ ID NO: 156806 - RNA, 1701 nt, Artificial Sequence
  derived and/or modified sequence opt4 from hemagglutinin__InfluenzaA__ADD74698
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156807 - RNA, 1701 nt, Artificial Sequence; identical to SEQ ID NO: 156741
  derived and/or modified sequence opt4 from hemagglutinin__InfluenzaA__ADD74708

SEQ ID NO: 156808 - RNA, 1701 nt, Artificial Sequence
  derived and/or modified sequence opt4 from hemagglutinin__InfluenzaA__ADD74728
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagcguggugcugguggugagccugggcgccaucagcuucuggaugugcagcaacggcagccugcagugcagaaucugcaucuga

SEQ ID NO: 156809 - RNA, 1701 nt, Artificial Sequence
  derived and/or modified sequence opt4 from hemagglutinin__InfluenzaA__ADD74738
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagaagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcggcuacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156810 - RNA, 1701 nt, Artificial Sequence; identical to SEQ ID NO: 156353
  derived and/or modified sequence opt4 from hemagglutinin__InfluenzaA__ADD74748

SEQ ID NO: 156811 - RNA, 1701 nt, Artificial Sequence; identical to SEQ ID NO: 156353
  derived and/or modified sequence opt4 from hemagglutinin__InfluenzaA__ADD74758

SEQ ID NO: 156812 - RNA, 1701 nt, Artificial Sequence
  derived and/or modified sequence opt4 from hemagglutinin__InfluenzaA__ADD74768
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugagcuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156813 - RNA, 1701 nt, Artificial Sequence; identical to SEQ ID NO: 156353
  derived and/or modified sequence opt4 from hemagglutinin__InfluenzaA__ADD74778

SEQ ID NO: 156814 - RNA, 1701 nt, Artificial Sequence; identical to SEQ ID NO: 156741
  derived and/or modified sequence opt4 from hemagglutinin__InfluenzaA__ADD74788

SEQ ID NO: 156815 - RNA, 1701 nt, Artificial Sequence; identical to SEQ ID NO: 156741
  derived and/or modified sequence opt4 from hemagglutinin__InfluenzaA__ADD74798

SEQ ID NO: 156816 - RNA, 1701 nt, Artificial Sequence
  derived and/or modified sequence opt4 from hemagglutinin__InfluenzaA__ADD74808
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 156817 - RNA, 1701 nt, Artificial Sequence
  derived and/or modified sequence opt4 from hemagglutinin__InfluenzaA__ADD74818
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuaccacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156818 - RNA, 1701 nt, Artificial Sequence
  derived and/or modified sequence opt4 from hemagglutinin__InfluenzaA__ADD74838
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156819 - RNA, 1701 nt, Artificial Sequence
  derived and/or modified sequence opt4 from hemagglutinin__InfluenzaA__ADD74848
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugaucgugagccugggcgccaucagcuucuggaugugcagcaacggcagccugcagugcagaaucugcaucuga

SEQ ID NO: 156820 - RNA, 1701 nt, Artificial Sequence
  derived and/or modified sequence opt4 from hemagglutinin__InfluenzaA__ADD74858
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcaccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156821 - RNA, 1701 nt, Artificial Sequence; identical to SEQ ID NO: 156741
  derived and/or modified sequence opt4 from hemagglutinin__InfluenzaA__ADD74868

SEQ ID NO: 156822 - RNA, 1701 nt, Artificial Sequence; identical to SEQ ID NO: 156741
  derived and/or modified sequence opt4 from hemagglutinin__InfluenzaA__ADD74878

SEQ ID NO: 156823 - RNA, 1701 nt, Artificial Sequence
  derived and/or modified sequence opt4 from hemagglutinin__InfluenzaA__ADD74888
augaaggccauccugguggugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccaacagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156824 - RNA, 1701 nt, Artificial Sequence
  derived and/or modified sequence opt4 from hemagglutinin__InfluenzaA__ADD74898
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156825 - RNA, 1701 nt, Artificial Sequence
  derived and/or modified sequence opt4 from hemagglutinin__InfluenzaA__ADD74908
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156826 - RNA, 1701 nt, Artificial Sequence; identical to SEQ ID NO: 156819
  derived and/or modified sequence opt4 from hemagglutinin__InfluenzaA__ADD74918

SEQ ID NO: 156827 - RNA, 1701 nt, Artificial Sequence; identical to SEQ ID NO: 156741
  derived and/or modified sequence opt4 from hemagglutinin__InfluenzaA__ADD74928

SEQ ID NO: 156828 - RNA, 1701 nt, Artificial Sequence; identical to SEQ ID NO: 156819
  derived and/or modified sequence opt4 from hemagglutinin__InfluenzaA__ADD74938

SEQ ID NO: 156829 - RNA, 1701 nt, Artificial Sequence
  derived and/or modified sequence opt4 from hemagglutinin__InfluenzaA__ADD74958
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggagaacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156830 - RNA, 1701 nt, Artificial Sequence; identical to SEQ ID NO: 156353
  derived and/or modified sequence opt4 from hemagglutinin__InfluenzaA__ADD74968

SEQ ID NO: 156831 - RNA, 1701 nt, Artificial Sequence
  derived and/or modified sequence opt4 from hemagglutinin__InfluenzaA__ADD74998
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagagaggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156832 - RNA, 1701 nt, Artificial Sequence; identical to SEQ ID NO: 156353
  derived and/or modified sequence opt4 from hemagglutinin__InfluenzaA__ADD75008

SEQ ID NO: 156833 - RNA, 1701 nt, Artificial Sequence; identical to SEQ ID NO: 156353
  derived and/or modified sequence opt4 from hemagglutinin__InfluenzaA__ADD75018

SEQ ID NO: 156834 - RNA, 1701 nt, Artificial Sequence; identical to SEQ ID NO: 156353
  derived and/or modified sequence opt4 from hemagglutinin__InfluenzaA__ADD75028

SEQ ID NO: 156835 - RNA, 1701 nt, Artificial Sequence; identical to SEQ ID NO: 156290
  derived and/or modified sequence opt4 from hemagglutinin__InfluenzaA__ADD75058

SEQ ID NO: 156836 - RNA, 1701 nt, Artificial Sequence; identical to SEQ ID NO: 156609
  derived and/or modified sequence opt4 from hemagglutinin__InfluenzaA__ADD75088

SEQ ID NO: 156837 - RNA, 1701 nt, Artificial Sequence; identical to SEQ ID NO: 155189
  derived and/or modified sequence opt4 from hemagglutinin__InfluenzaA__ADD75098

SEQ ID NO: 156838 - RNA, 1701 nt, Artificial Sequence
  derived and/or modified sequence opt4 from hemagglutinin__InfluenzaA__ADD75108
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156839 - RNA, 1701 nt, Artificial Sequence; identical to SEQ ID NO: 155189
  derived and/or modified sequence opt4 from hemagglutinin__InfluenzaA__ADD75118

SEQ ID NO: 156840 - RNA, 1701 nt, Artificial Sequence; identical to SEQ ID NO: 155636
  derived and/or modified sequence opt4 from hemagglutinin__InfluenzaA__ADD75128

SEQ ID NO: 156841 - RNA, 1701 nt, Artificial Sequence; identical to SEQ ID NO: 155189
  derived and/or modified sequence opt4 from hemagglutinin__InfluenzaA__ADD75138

SEQ ID NO: 156842 - RNA, 1701 nt, Artificial Sequence; identical to SEQ ID NO: 156353
  derived and/or modified sequence opt4 from hemagglutinin__InfluenzaA__ADD75148

SEQ ID NO: 156843 - RNA, 1701 nt, Artificial Sequence; identical to SEQ ID NO: 155189
  derived and/or modified sequence opt4 from hemagglutinin__InfluenzaA__ADD75158

SEQ ID NO: 156844 - RNA, 1701 nt, Artificial Sequence
  derived and/or modified sequence opt4 from hemagglutinin__InfluenzaA__ADD84494
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaucagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacggcugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156845 - RNA, 1701 nt, Artificial Sequence
  derived and/or modified sequence opt4 from hemagglutinin__InfluenzaA__ADD84495
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaucagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156846 - RNA, 1701 nt, Artificial Sequence
  derived and/or modified sequence opt4 from hemagglutinin__InfluenzaA__ADD84496
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaucagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156847 - RNA, 1701 nt, Artificial Sequence; identical to SEQ ID NO: 156845
  derived and/or modified sequence opt4 from hemagglutinin__InfluenzaA__ADD84497

SEQ ID NO: 156848 - RNA, 1701 nt, Artificial Sequence
  derived and/or modified sequence opt4 from hemagglutinin__InfluenzaA__ADD84498
augaaggccauccugguggugcugcuguacaccuucgccaccgccaacgccgacacccugugcaucggcuaccacgccaacaacagcaccgacaccguggugaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaucagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156849 - RNA, 1701 nt, Artificial Sequence; identical to SEQ ID NO: 156845
  derived and/or modified sequence opt4 from hemagglutinin__InfluenzaA__ADD84499

SEQ ID NO: 156850 - RNA, 1701 nt, Artificial Sequence
  derived and/or modified sequence opt4 from hemagglutinin__InfluenzaA__ADD92535
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacagagugaacagcgugaucgagaagaugaacacccaguucaccgccgugggcaaggaguucaaccaccuggagaagagaaucgagaaccugaacaagaagguggacggcggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156851 - RNA, 1701 nt, Artificial Sequence; identical to SEQ ID NO: 156777
  derived and/or modified sequence opt4 from hemagglutinin__InfluenzaA__ADD96766

SEQ ID NO: 156852 - RNA, 1701 nt, Artificial Sequence; identical to SEQ ID NO: 155369
  derived and/or modified sequence opt4 from hemagglutinin__InfluenzaA__ADD96776

SEQ ID NO: 156853 - RNA, 1701 nt, Artificial Sequence; identical to SEQ ID NO: 155369
  derived and/or modified sequence opt4 from hemagglutinin__InfluenzaA__ADD96786

SEQ ID NO: 156854 - RNA, 1701 nt, Artificial Sequence; identical to SEQ ID NO: 156674
  derived and/or modified sequence opt4 from hemagglutinin__InfluenzaA__ADD96796

SEQ ID NO: 156855 - RNA, 1701 nt, Artificial Sequence
  derived and/or modified sequence opt4 from hemagglutinin__InfluenzaA__ADD96806
augaaggccauccugguggugcugcuguacacccuggccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156856 - RNA, 1701 nt, Artificial Sequence; identical to SEQ ID NO: 156353
  derived and/or modified sequence opt4 from hemagglutinin__InfluenzaA__ADD96816

SEQ ID NO: 156857 - RNA, 1701 nt, Artificial Sequence
  derived and/or modified sequence opt4 from hemagglutinin__InfluenzaA__ADD96826
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugauggaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucgccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156858 - RNA, 1701 nt, Artificial Sequence; identical to SEQ ID NO: 155189
  derived and/or modified sequence opt4 from hemagglutinin__InfluenzaA__ADD96836

SEQ ID NO: 156859 - RNA, 1701 nt, Artificial Sequence; identical to SEQ ID NO: 155189
  derived and/or modified sequence opt4 from hemagglutinin__InfluenzaA__ADD96846

SEQ ID NO: 156860 - RNA, 1701 nt, Artificial Sequence; identical to SEQ ID NO: 156741
  derived and/or modified sequence opt4 from hemagglutinin__InfluenzaA__ADD96856

SEQ ID NO: 156861 - RNA, 1701 nt, Artificial Sequence; identical to SEQ ID NO: 155542
  derived and/or modified sequence opt4 from hemagglutinin__InfluenzaA__ADD96886

SEQ ID NO: 156862 - RNA, 1701 nt, Artificial Sequence; identical to SEQ ID NO: 156816
  derived and/or modified sequence opt4 from hemagglutinin__InfluenzaA__ADD96896

SEQ ID NO: 156863 - RNA, 1701 nt, Artificial Sequence; identical to SEQ ID NO: 156353
  derived and/or modified sequence opt4 from hemagglutinin__InfluenzaA__ADD96906

SEQ ID NO: 156864 - RNA, 1701 nt, Artificial Sequence; identical to SEQ ID NO: 156353
  derived and/or modified sequence opt4 from hemagglutinin__InfluenzaA__ADD96916

SEQ ID NO: 156865 - RNA, 1701 nt, Artificial Sequence; identical to SEQ ID NO: 156353
  derived and/or modified sequence opt4 from hemagglutinin__InfluenzaA__ADD96926

SEQ ID NO: 156866 - RNA, 1701 nt, Artificial Sequence
  derived and/or modified sequence opt4 from hemagglutinin__InfluenzaA__ADD96936
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcugaucaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156867 - RNA, 1701 nt, Artificial Sequence
  derived and/or modified sequence opt4 from hemagglutinin__InfluenzaA__ADD96946
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucaagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcgagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156868 - RNA, 1701 nt, Artificial Sequence
  derived and/or modified sequence opt4 from hemagglutinin__InfluenzaA__ADD96956
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccuggugaagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156869 - RNA, 1701 nt, Artificial Sequence; identical to SEQ ID NO: 155189
  derived and/or modified sequence opt4 from hemagglutinin__InfluenzaA__ADD96976

SEQ ID NO: 156870 - RNA, 1701 nt, Artificial Sequence; identical to SEQ ID NO: 155189
  derived and/or modified sequence opt4 from hemagglutinin__InfluenzaA__ADD96986

SEQ ID NO: 156871 - RNA, 1701 nt, Artificial Sequence
  derived and/or modified sequence opt4 from hemagglutinin__InfluenzaA__ADD97035
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagaauggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156872 - RNA, 1701 nt, Artificial Sequence
  derived and/or modified sequence opt4 from hemagglutinin__InfluenzaA__ADD97045
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaccgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156873 - RNA, 1701 nt, Artificial Sequence; identical to SEQ ID NO: 156872
  derived and/or modified sequence opt4 from hemagglutinin__InfluenzaA__ADD97055

SEQ ID NO: 156874 - RNA, 1701 nt, Artificial Sequence; identical to SEQ ID NO: 156872
  derived and/or modified sequence opt4 from hemagglutinin__InfluenzaA__ADD97123

SEQ ID NO: 156875 - RNA, 1701 nt, Artificial Sequence
  derived and/or modified sequence opt4 from hemagglutinin__InfluenzaA__ADD97161
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaagagcuaccccaagcugagcaagagcuacaucaacgacaagggcaagaaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156876 - RNA, 1701 nt, Artificial Sequence
  derived and/or modified sequence opt4 from hemagglutinin__InfluenzaA__ADD97171
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccgugagcuucuggaugugcagcaacggcagccugcagugcagaaucugcaucuga

SEQ ID NO: 156877 - RNA, 1701 nt, Artificial Sequence; identical to SEQ ID NO: 155189
  derived and/or modified sequence opt4 from hemagglutinin__InfluenzaA__ADD97181

SEQ ID NO: 156878 - RNA, 1701 nt, Artificial Sequence; identical to SEQ ID NO: 155189
  derived and/or modified sequence opt4 from hemagglutinin__InfluenzaA__ADD97201

SEQ ID NO: 156879 - RNA, 1701 nt, Artificial Sequence; identical to SEQ ID NO: 156872
  derived and/or modified sequence opt4 from hemagglutinin__InfluenzaA__ADD97211

SEQ ID NO: 156880 - RNA, 1701 nt, Artificial Sequence; identical to SEQ ID NO: 155189
  derived and/or modified sequence opt4 from hemagglutinin__InfluenzaA__ADD97231

SEQ ID NO: 156881 - RNA, 1701 nt, Artificial Sequence
  derived and/or modified sequence opt4 from hemagglutinin__InfluenzaA__ADD97241
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaccgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156882 - RNA, 1701 nt, Artificial Sequence; identical to SEQ ID NO: 156872
  derived and/or modified sequence opt4 from hemagglutinin__InfluenzaA__ADD97251

SEQ ID NO: 156883 - RNA, 1701 nt, Artificial Sequence; identical to SEQ ID NO: 155189
  derived and/or modified sequence opt4 from hemagglutinin__InfluenzaA__ADD97261

SEQ ID NO: 156884 - RNA, 1701 nt, Artificial Sequence
  derived and/or modified sequence opt4 from hemagglutinin__InfluenzaA__ADD97271
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugaccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156885 - RNA, 1701 nt, Artificial Sequence; identical to SEQ ID NO: 156876
  derived and/or modified sequence opt4 from hemagglutinin__InfluenzaA__ADD97281

SEQ ID NO: 156886 - RNA, 1701 nt, Artificial Sequence; identical to SEQ ID NO: 155189
  derived and/or modified sequence opt4 from hemagglutinin__InfluenzaA__ADD97291

SEQ ID NO: 156887 - RNA, 1701 nt, Artificial Sequence
  derived and/or modified sequence opt4 from hemagglutinin__InfluenzaA__ADD97311
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggagauccuggugcuguggggcauccaccaccccagcaccaucgccgaccagcagagccuguaccagaacgccgacgccuacguguucgugggcaccagcagauacagcaagaaguucaagcccgagaucgccaucagacccaaggugagagaccaggagggcagaaugaaguacuacuggacccugguggagcccggcgacaagaucaccuucgaggccaccggcaaccugguggugcccagauacgccuucgccauggagagaaacgccggcagcggcaucaucaucagcgacacccccgugcacaacugcaacaccaccugccagaccagcaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156888 - RNA, 1701 nt, Artificial Sequence; identical to SEQ ID NO: 156872
  derived and/or modified sequence opt4 from hemagglutinin__InfluenzaA__ADD97321

SEQ ID NO: 156889 - RNA, 1701 nt, Artificial Sequence; identical to SEQ ID NO: 156353
  derived and/or modified sequence opt4 from hemagglutinin__InfluenzaA__ADD97331

SEQ ID NO: 156890 - RNA, 1701 nt, Artificial Sequence
  derived and/or modified sequence opt4 from hemagglutinin__InfluenzaA__ADD97341
augaaggccauccugguggugcugcuguacaccuucgccaccgugaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156891 - RNA, 1701 nt, Artificial Sequence; identical to SEQ ID NO: 156353
  derived and/or modified sequence opt4 from hemagglutinin__InfluenzaA__ADD97351

SEQ ID NO: 156892 - RNA, 1701 nt, Artificial Sequence; identical to SEQ ID NO: 156353
  derived and/or modified sequence opt4 from hemagglutinin__InfluenzaA__ADD97361

SEQ ID NO: 156893 - RNA, 1701 nt, Artificial Sequence
  derived and/or modified sequence opt4 from hemagglutinin__InfluenzaA__ADD97371
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagagugugcaucuga

SEQ ID NO: 156894 - RNA, 1701 nt, Artificial Sequence; identical to SEQ ID NO: 156353
  derived and/or modified sequence opt4 from hemagglutinin__InfluenzaA__ADD97381

SEQ ID NO: 156895 - RNA, 1701 nt, Artificial Sequence; identical to SEQ ID NO: 155189
  derived and/or modified sequence opt4 from hemagglutinin__InfluenzaA__ADD97391

SEQ ID NO: 156896 - RNA, 1701 nt, Artificial Sequence; identical to SEQ ID NO: 156353
  derived and/or modified sequence opt4 from hemagglutinin__InfluenzaA__ADD97411

SEQ ID NO: 156897 - RNA, 1701 nt, Artificial Sequence; identical to SEQ ID NO: 156353
  derived and/or modified sequence opt4 from hemagglutinin__InfluenzaA__ADD97421

SEQ ID NO: 156898 - RNA, 1701 nt, Artificial Sequence; identical to SEQ ID NO: 155189
  derived and/or modified sequence opt4 from hemagglutinin__InfluenzaA__ADD97431

SEQ ID NO: 156899 - RNA, 1701 nt, Artificial Sequence
  derived and/or modified sequence opt4 from hemagglutinin__InfluenzaA__ADD97441
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggagauccuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156900 - RNA, 1701 nt, Artificial Sequence; identical to SEQ ID NO: 156893
  derived and/or modified sequence opt4 from hemagglutinin__InfluenzaA__ADD97451

SEQ ID NO: 156901 - RNA, 1701 nt, Artificial Sequence; identical to SEQ ID NO: 156893
  derived and/or modified sequence opt4 from hemagglutinin__InfluenzaA__ADD97461

SEQ ID NO: 156902 - RNA, 1701 nt, Artificial Sequence; identical to SEQ ID NO: 156741
  derived and/or modified sequence opt4 from hemagglutinin__InfluenzaA__ADD97471

SEQ ID NO: 156903 - RNA, 1701 nt, Artificial Sequence; identical to SEQ ID NO: 156741
  derived and/or modified sequence opt4 from hemagglutinin__InfluenzaA__ADD97481

SEQ ID NO: 156904 - RNA, 1701 nt, Artificial Sequence
  derived and/or modified sequence opt4 from hemagglutinin__InfluenzaA__ADD97491
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgaggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156905 - RNA, 1701 nt, Artificial Sequence; identical to SEQ ID NO: 156904
  derived and/or modified sequence opt4 from hemagglutinin__InfluenzaA__ADD97501

SEQ ID NO: 156906 - RNA, 1701 nt, Artificial Sequence; identical to SEQ ID NO: 155542
  derived and/or modified sequence opt4 from hemagglutinin__InfluenzaA__ADD97511

SEQ ID NO: 156907 - RNA, 1701 nt, Artificial Sequence
  derived and/or modified sequence opt4 from hemagglutinin__InfluenzaA__ADD97531
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggagauccuggugcuguggggcauccaccaccccagcaccaucgccgaccagcagagccuguaccagaacgccgacgccuacguguucgugggcaccagcagauacagcaagaaguucaagcccgagaucgccaucagacccaaggugagagaccaggagggcagaaugaaguacuacuggacccugguggagcccggcgacaagaucaccuucgaggccaccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156908 - RNA, 1701 nt, Artificial Sequence
  derived and/or modified sequence opt4 from hemagglutinin__InfluenzaA__ADD97541
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacaccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgcccacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156909 - RNA, 1701 nt, Artificial Sequence; identical to SEQ ID NO: 156741
  derived and/or modified sequence opt4 from hemagglutinin__InfluenzaA__ADD97551

SEQ ID NO: 156910 - RNA, 1701 nt, Artificial Sequence; identical to SEQ ID NO: 156353
  derived and/or modified sequence opt4 from hemagglutinin__InfluenzaA__ADD97561

SEQ ID NO: 156911 - RNA, 1701 nt, Artificial Sequence
  derived and/or modified sequence opt4 from hemagglutinin__InfluenzaA__ADD97571
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagccuguucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156912 - RNA, 1701 nt, Artificial Sequence; identical to SEQ ID NO: 155189
  derived and/or modified sequence opt4 from hemagglutinin__InfluenzaA__ADD97581

SEQ ID NO: 156913 - RNA, 1701 nt, Artificial Sequence; identical to SEQ ID NO: 155189
  derived and/or modified sequence opt4 from hemagglutinin__InfluenzaA__ADD97591

SEQ ID NO: 156914 - RNA, 1701 nt, Artificial Sequence; identical to SEQ ID NO: 155189
  derived and/or modified sequence opt4 from hemagglutinin__InfluenzaA__ADD97688

SEQ ID NO: 156915 - RNA, 1701 nt, Artificial Sequence; identical to SEQ ID NO: 156741
  derived and/or modified sequence opt4 from hemagglutinin__InfluenzaA__ADD97698

SEQ ID NO: 156916 - RNA, 1701 nt, Artificial Sequence; identical to SEQ ID NO: 156741
  derived and/or modified sequence opt4 from hemagglutinin__InfluenzaA__ADD97888

SEQ ID NO: 156917 - RNA, 1701 nt, Artificial Sequence
  derived and/or modified sequence opt4 from hemagglutinin__InfluenzaA__ADD97898
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156918 - RNA, 1701 nt, Artificial Sequence; identical to SEQ ID NO: 155542
  derived and/or modified sequence opt4 from hemagglutinin__InfluenzaA__ADD97908

SEQ ID NO: 156919 - RNA, 1701 nt, Artificial Sequence; identical to SEQ ID NO: 156353
  derived and/or modified sequence opt4 from hemagglutinin__InfluenzaA__ADD97918

SEQ ID NO: 156920 - RNA, 1701 nt, Artificial Sequence
  derived and/or modified sequence opt4 from hemagglutinin__InfluenzaA__ADD97928
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguuccaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156921 - RNA, 1701 nt, Artificial Sequence
  derived and/or modified sequence opt4 from hemagglutinin__InfluenzaA__ADD97938
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaugaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggagauccuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156922 - RNA, 1701 nt, Artificial Sequence
  derived and/or modified sequence opt4 from hemagglutinin__InfluenzaA__ADD97948
augaaggccauccugcuggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156923 - RNA, 1701 nt, Artificial Sequence
  derived and/or modified sequence opt4 from hemagglutinin__InfluenzaA__ADD97958
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguuccagcccgagaucgccaucagacccaaggugagagaccaggagggcagaaugaacuacuacuggacccugcuggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156924 - RNA, 1701 nt, Artificial Sequence; identical to SEQ ID NO: 155189
  derived and/or modified sequence opt4 from hemagglutinin__InfluenzaA__ADD97968

SEQ ID NO: 156925 - RNA, 1701 nt, Artificial Sequence; identical to SEQ ID NO: 156917
  derived and/or modified sequence opt4 from hemagglutinin__InfluenzaA__ADD97978

SEQ ID NO: 156926 - RNA, 1701 nt, Artificial Sequence; identical to SEQ ID NO: 156871
  derived and/or modified sequence opt4 from hemagglutinin__InfluenzaA__ADD97988

SEQ ID NO: 156927 - RNA, 1701 nt, Artificial Sequence
  derived and/or modified sequence opt4 from hemagglutinin__InfluenzaA__ADD97998
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaaggccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgagauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156928 - RNA, 1701 nt, Artificial Sequence; identical to SEQ ID NO: 156741
  derived and/or modified sequence opt4 from hemagglutinin__InfluenzaA__ADD98008

SEQ ID NO: 156929 - RNA, 1701 nt, Artificial Sequence
  derived and/or modified sequence opt4 from hemagglutinin__InfluenzaA__ADD98018
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggagauccuggugcuguggggcauccaccaccccagcaccagcgccgaccagcagagccuguaccagaacgccgacgccuacguguucgugggcaccagcagauacagcaagaaguucaagcccgagaucgccaccagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156930 - RNA, 1701 nt, Artificial Sequence; identical to SEQ ID NO: 156893
  derived and/or modified sequence opt4 from hemagglutinin__InfluenzaA__ADD98028

SEQ ID NO: 156931 - RNA, 1701 nt, Artificial Sequence
  derived and/or modified sequence opt4 from hemagglutinin__InfluenzaA__ADD98038
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagcaucagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaaggccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgagauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156932 - RNA, 1701 nt, Artificial Sequence; identical to SEQ ID NO: 156917
  derived and/or modified sequence opt4 from hemagglutinin__InfluenzaA__ADD98048

SEQ ID NO: 156933 - RNA, 1701 nt, Artificial Sequence; identical to SEQ ID NO: 155189
  derived and/or modified sequence opt4 from hemagglutinin__InfluenzaA__ADD98058

SEQ ID NO: 156934 - RNA, 1701 nt, Artificial Sequence; identical to SEQ ID NO: 155189
  derived and/or modified sequence opt4 from hemagglutinin__InfluenzaA__ADD98068

SEQ ID NO: 156935 - RNA, 1701 nt, Artificial Sequence; identical to SEQ ID NO: 155431
  derived and/or modified sequence opt4 from hemagglutinin__InfluenzaA__ADD98078

SEQ ID NO: 156936 - RNA, 1701 nt, Artificial Sequence
  derived and/or modified sequence opt4 from hemagglutinin__InfluenzaA__ADD98098
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcagcgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccguggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156937 - RNA, 1701 nt, Artificial Sequence; identical to SEQ ID NO: 156904
  derived and/or modified sequence opt4 from hemagglutinin__InfluenzaA__ADD98118

SEQ ID NO: 156938 - RNA, 1701 nt, Artificial Sequence; identical to SEQ ID NO: 156904
  derived and/or modified sequence opt4 from hemagglutinin__InfluenzaA__ADD98128

SEQ ID NO: 156939 - RNA, 1701 nt, Artificial Sequence
  derived and/or modified sequence opt4 from hemagglutinin__InfluenzaA__ADD98138
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacaccggcagcggcaucaucaucagcgacacccccgugcacgacugcaacaccaccugccagacccccaacggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156940 - RNA, 1701 nt, Artificial Sequence
  derived and/or modified sequence opt4 from hemagglutinin__InfluenzaA__ADD98148
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucuucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156941 - RNA, 1701 nt, Artificial Sequence
  derived and/or modified sequence opt4 from hemagglutinin__InfluenzaA__ADD98158
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcgagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccuggugauccccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156942 - RNA, 1701 nt, Artificial Sequence
  derived and/or modified sequence opt4 from hemagglutinin__InfluenzaA__ADD98168
augaaggccauccugguggugcugcuguacaccuucgccaccgccaacgccgacacccugugcaucggcuaccacgccaacaacagcaccgacaccguggacaccgugcuggagaagaacgugaccgugacccacagcaucaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccaaguacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156943 - RNA, 1701 nt, Artificial Sequence; identical to SEQ ID NO: 156361
  derived and/or modified sequence opt4 from hemagglutinin__InfluenzaA__ADD98188

SEQ ID NO: 156944 - RNA, 1701 nt, Artificial Sequence
  derived and/or modified sequence opt4 from hemagglutinin__InfluenzaA__ADD98198
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagaugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156945 - RNA, 1701 nt, Artificial Sequence; identical to SEQ ID NO: 155189
  derived and/or modified sequence opt4 from hemagglutinin__InfluenzaA__ADD98208

SEQ ID NO: 156946 - RNA, 1701 nt, Artificial Sequence; identical to SEQ ID NO: 155369
  derived and/or modified sequence opt4 from hemagglutinin__InfluenzaA__ADE20321

SEQ ID NO: 156947 - RNA, 1701 nt, Artificial Sequence; identical to SEQ ID NO: 155369
  derived and/or modified sequence opt4 from hemagglutinin__InfluenzaA__ADE20331

SEQ ID NO: 156948 - RNA, 1701 nt, Artificial Sequence; identical to SEQ ID NO: 155369
  derived and/or modified sequence opt4 from hemagglutinin__InfluenzaA__ADE20341

SEQ ID NO: 156949 - RNA, 1701 nt, Artificial Sequence; identical to SEQ ID NO: 156777
  derived and/or modified sequence opt4 from hemagglutinin__InfluenzaA__ADE20351

SEQ ID NO: 156950 - RNA, 1701 nt, Artificial Sequence; identical to SEQ ID NO: 155369
  derived and/or modified sequence opt4 from hemagglutinin__InfluenzaA__ADE20375

SEQ ID NO: 156951 - RNA, 1701 nt, Artificial Sequence; identical to SEQ ID NO: 156777
  derived and/or modified sequence opt4 from hemagglutinin__InfluenzaA__ADE20388

SEQ ID NO: 156952 - RNA, 1701 nt, Artificial Sequence; identical to SEQ ID NO: 155369
  derived and/or modified sequence opt4 from hemagglutinin__InfluenzaA__ADE20628

SEQ ID NO: 156953 - RNA, 1701 nt, Artificial Sequence; identical to SEQ ID NO: 156777
  derived and/or modified sequence opt4 from hemagglutinin__InfluenzaA__ADE20638

SEQ ID NO: 156954 - RNA, 1701 nt, Artificial Sequence; identical to SEQ ID NO: 155369
  derived and/or modified sequence opt4 from hemagglutinin__InfluenzaA__ADE20648

SEQ ID NO: 156955 - RNA, 1701 nt, Artificial Sequence; identical to SEQ ID NO: 155369
  derived and/or modified sequence opt4 from hemagglutinin__InfluenzaA__ADE20658

SEQ ID NO: 156956 - RNA, 1701 nt, Artificial Sequence; identical to SEQ ID NO: 156777
  derived and/or modified sequence opt4 from hemagglutinin__InfluenzaA__ADE20668

SEQ ID NO: 156957 - RNA, 1701 nt, Artificial Sequence; identical to SEQ ID NO: 156777
  derived and/or modified sequence opt4 from hemagglutinin__InfluenzaA__ADE20678

SEQ ID NO: 156958 - RNA, 1701 nt, Artificial Sequence; identical to SEQ ID NO: 155369
  derived and/or modified sequence opt4 from hemagglutinin__InfluenzaA__ADE20688

SEQ ID NO: 156959 - RNA, 1701 nt, Artificial Sequence; identical to SEQ ID NO: 155369
  derived and/or modified sequence opt4 from hemagglutinin__InfluenzaA__ADE20708

SEQ ID NO: 156960 - RNA, 1701 nt, Artificial Sequence; identical to SEQ ID NO: 155369
  derived and/or modified sequence opt4 from hemagglutinin__InfluenzaA__ADE20718

SEQ ID NO: 156961 - RNA, 1701 nt, Artificial Sequence
  derived and/or modified sequence opt4 from hemagglutinin__InfluenzaA__ADE20728
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugaagggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156962 - RNA, 1701 nt, Artificial Sequence; identical to SEQ ID NO: 155369
  derived and/or modified sequence opt4 from hemagglutinin__InfluenzaA__ADE20738

SEQ ID NO: 156963 - RNA, 1701 nt, Artificial Sequence; identical to SEQ ID NO: 155369
  derived and/or modified sequence opt4 from hemagglutinin__InfluenzaA__ADE20748

SEQ ID NO: 156964 - RNA, 1701 nt, Artificial Sequence; identical to SEQ ID NO: 156961
  derived and/or modified sequence opt4 from hemagglutinin__InfluenzaA__ADE20758

SEQ ID NO: 156965 - RNA, 1701 nt, Artificial Sequence; identical to SEQ ID NO: 155369
  derived and/or modified sequence opt4 from hemagglutinin__InfluenzaA__ADE20768

SEQ ID NO: 156966 - RNA, 1701 nt, Artificial Sequence
  derived and/or modified sequence opt4 from hemagglutinin__InfluenzaA__ADE20778
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugaagggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaagaaggugcuggugcuguggggcauccaccaccccagcaccagcgccgaccagcagagccuguaccagaacgccgacgccuacguguucgugggcagcagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156967 - RNA, 1701 nt, Artificial Sequence; identical to SEQ ID NO: 156353
  derived and/or modified sequence opt4 from hemagglutinin__InfluenzaA__ADE20788

SEQ ID NO: 156968 - RNA, 1701 nt, Artificial Sequence
  derived and/or modified sequence opt4 from hemagglutinin__InfluenzaA__ADE20808
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaaggagaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156969 - RNA, 1701 nt, Artificial Sequence; identical to SEQ ID NO: 156353
  derived and/or modified sequence opt4 from hemagglutinin__InfluenzaA__ADE20818

SEQ ID NO: 156970 - RNA, 1701 nt, Artificial Sequence; identical to SEQ ID NO: 156911
  derived and/or modified sequence opt4 from hemagglutinin__InfluenzaA__ADE20828

SEQ ID NO: 156971 - RNA, 1701 nt, Artificial Sequence
  derived and/or modified sequence opt4 from hemagglutinin__InfluenzaA__ADE20848
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugaucgacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156972 - RNA, 1701 nt, Artificial Sequence; identical to SEQ ID NO: 156353
  derived and/or modified sequence opt4 from hemagglutinin__InfluenzaA__ADE20858

SEQ ID NO: 156973 - RNA, 1701 nt, Artificial Sequence
  derived and/or modified sequence opt4 from hemagglutinin__InfluenzaA__ADE20868
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggagggcaagcacaacggcaagcugugcaagcugagaggcguggccccccugcaccugggcaagugcaacaucgccggcuggauccugggcaaccccgagugcgagagccugaccaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156974 - RNA, 1701 nt, Artificial Sequence; identical to SEQ ID NO: 156907
  derived and/or modified sequence opt4 from hemagglutinin__InfluenzaA__ADE20878

SEQ ID NO: 156975 - RNA, 1701 nt, Artificial Sequence; identical to SEQ ID NO: 156291
  derived and/or modified sequence opt4 from hemagglutinin__InfluenzaA__ADE20888

SEQ ID NO: 156976 - RNA, 1701 nt, Artificial Sequence
  derived and/or modified sequence opt4 from hemagglutinin__InfluenzaA__ADE20898
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggagauccuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagggcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156977 - RNA, 1701 nt, Artificial Sequence; identical to SEQ ID NO: 156940
  derived and/or modified sequence opt4 from hemagglutinin__InfluenzaA__ADE20908

SEQ ID NO: 156978 - RNA, 1701 nt, Artificial Sequence
  derived and/or modified sequence opt4 from hemagglutinin__InfluenzaA__ADE20918
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggauccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156979 - RNA, 1701 nt, Artificial Sequence; identical to SEQ ID NO: 155542
  derived and/or modified sequence opt4 from hemagglutinin__InfluenzaA__ADE20928

SEQ ID NO: 156980 - RNA, 1701 nt, Artificial Sequence
  derived and/or modified sequence opt4 from hemagglutinin__InfluenzaA__ADE20948
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacagcuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156981 - RNA, 1701 nt, Artificial Sequence
  derived and/or modified sequence opt4 from hemagglutinin__InfluenzaA__ADE20968
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgaggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacagcggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156982 - RNA, 1701 nt, Artificial Sequence; identical to SEQ ID NO: 156353
  derived and/or modified sequence opt4 from hemagglutinin__InfluenzaA__ADE20978

SEQ ID NO: 156983 - RNA, 1701 nt, Artificial Sequence
  derived and/or modified sequence opt4 from hemagglutinin__InfluenzaA__ADE20988
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaagagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156984 - RNA, 1701 nt, Artificial Sequence; identical to SEQ ID NO: 156353
  derived and/or modified sequence opt4 from hemagglutinin__InfluenzaA__ADE20998

SEQ ID NO: 156985 - RNA, 1701 nt, Artificial Sequence; identical to SEQ ID NO: 156517
  derived and/or modified sequence opt4 from hemagglutinin__InfluenzaA__ADE21008

SEQ ID NO: 156986 - RNA, 1701 nt, Artificial Sequence
  derived and/or modified sequence opt4 from hemagglutinin__InfluenzaA__ADE21018
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccaccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156987 - RNA, 1701 nt, Artificial Sequence; identical to SEQ ID NO: 156927
  derived and/or modified sequence opt4 from hemagglutinin__InfluenzaA__ADE21028

SEQ ID NO: 156988 - RNA, 1701 nt, Artificial Sequence; identical to SEQ ID NO: 156917
  derived and/or modified sequence opt4 from hemagglutinin__InfluenzaA__ADE21038

SEQ ID NO: 156989 - RNA, 1701 nt, Artificial Sequence; identical to SEQ ID NO: 156940
  derived and/or modified sequence opt4 from hemagglutinin__InfluenzaA__ADE21048

SEQ ID NO: 156990 - RNA, 1701 nt, Artificial Sequence
  derived and/or modified sequence opt4 from hemagglutinin__InfluenzaA__ADE21058
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaucaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156991 - RNA, 1701 nt, Artificial Sequence
  derived and/or modified sequence opt4 from hemagglutinin__InfluenzaA__ADE21068
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaccggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156992 - RNA, 1698 nt, Artificial Sequence
  derived and/or modified sequence opt4 from hemagglutinin__InfluenzaA__ADE28761
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgagagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcauggagguguaccagauccuggccaucuacagcaccguggccagcagccuggugcugcuggugagccugggcgccaucagcuucuggaugugcagcaacggcagccugcagugcagaaucugcaucuga

SEQ ID NO: 156993 - RNA, 1701 nt, Artificial Sequence; identical to SEQ ID NO: 155369
  derived and/or modified sequence opt4 from hemagglutinin__InfluenzaA__ADE28780

SEQ ID NO: 156994 - RNA, 1701 nt, Artificial Sequence; identical to SEQ ID NO: 156777
  derived and/or modified sequence opt4 from hemagglutinin__InfluenzaA__ADE28790

SEQ ID NO: 156995 - RNA, 1701 nt, Artificial Sequence; identical to SEQ ID NO: 156961
  derived and/or modified sequence opt4 from hemagglutinin__InfluenzaA__ADE28800

SEQ ID NO: 156996 - RNA, 1701 nt, Artificial Sequence; identical to SEQ ID NO: 156353
  derived and/or modified sequence opt4 from hemagglutinin__InfluenzaA__ADE28810

SEQ ID NO: 156997 - RNA, 1701 nt, Artificial Sequence
  derived and/or modified sequence opt4 from hemagglutinin__InfluenzaA__ADE28820
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcagccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 156998 - RNA, 1701 nt, Artificial Sequence; identical to SEQ ID NO: 155369
  derived and/or modified sequence opt4 from hemagglutinin__InfluenzaA__ADE28830

SEQ ID NO: 156999 - RNA, 1701 nt, Artificial Sequence; identical to SEQ ID NO: 155369
  derived and/or modified sequence opt4 from hemagglutinin__InfluenzaA__ADE28840

SEQ ID NO: 157000 - RNA, 1701 nt, Artificial Sequence; identical to SEQ ID NO: 155369
  derived and/or modified sequence opt4 from hemagglutinin__InfluenzaA__ADE28850

SEQ ID NO: 157001 - RNA, 1701 nt, Artificial Sequence; identical to SEQ ID NO: 155369
  derived and/or modified sequence opt4 from hemagglutinin__InfluenzaA__ADE28881

SEQ ID NO: 157002 - RNA, 1701 nt, Artificial Sequence; identical to SEQ ID NO: 155369
  derived and/or modified sequence opt4 from hemagglutinin__InfluenzaA__ADE28891

SEQ ID NO: 157003 - RNA, 1701 nt, Artificial Sequence; identical to SEQ ID NO: 156872
  derived and/or modified sequence opt4 from hemagglutinin__InfluenzaA__ADE28911

SEQ ID NO: 157004 - RNA, 1701 nt, Artificial Sequence; identical to SEQ ID NO: 156353
  derived and/or modified sequence opt4 from hemagglutinin__InfluenzaA__ADE28921

SEQ ID NO: 157005 - RNA, 1701 nt, Artificial Sequence; identical to SEQ ID NO: 156353
  derived and/or modified sequence opt4 from hemagglutinin__InfluenzaA__ADE28931

SEQ ID NO: 157006 - RNA, 1701 nt, Artificial Sequence; identical to SEQ ID NO: 155542
  derived and/or modified sequence opt4 from hemagglutinin__InfluenzaA__ADE28951

SEQ ID NO: 157007 - RNA, 1701 nt, Artificial Sequence
  derived and/or modified sequence opt4 from hemagglutinin__InfluenzaA__ADE28961
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacguggccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157008 - RNA, 1701 nt, Artificial Sequence; identical to SEQ ID NO: 156893
  derived and/or modified sequence opt4 from hemagglutinin__InfluenzaA__ADE28971

SEQ ID NO: 157009 - RNA, 1701 nt, Artificial Sequence
  derived and/or modified sequence opt4 from hemagglutinin__InfluenzaA__ADE28981
augaaggccauccugguggugcugcuguacaccuucgccaccgccaacgccgacacccugugcaucggcuaccacgccaacaacagcaccgagaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157010 - RNA, 1701 nt, Artificial Sequence; identical to SEQ ID NO: 156353
  derived and/or modified sequence opt4 from hemagglutinin__InfluenzaA__ADE28991

SEQ ID NO: 157011 - RNA, 1701 nt, Artificial Sequence
  derived and/or modified sequence opt4 from hemagglutinin__InfluenzaA__ADE29001
augaaggccauccugguggugcugcuguacaccuucgccaccgccaacgccgacacccugugcaucggcuaccacgccaacaacagcaccgacaccguggacaccgugcuggagagaaacgugaccgugacccacagcgugaaccugcuggaggacaagcacaacggcaagcugugcaagcugaagggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157012 - RNA, 1701 nt, Artificial Sequence; identical to SEQ ID NO: 155431
  derived and/or modified sequence opt4 from hemagglutinin__InfluenzaA__ADE29011

SEQ ID NO: 157013 - RNA, 1701 nt, Artificial Sequence
  derived and/or modified sequence opt4 from hemagglutinin__InfluenzaA__ADE29021
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcggcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacgugagcgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157014 - RNA, 1701 nt, Artificial Sequence; identical to SEQ ID NO: 156838
  derived and/or modified sequence opt4 from hemagglutinin__InfluenzaA__ADE29031

SEQ ID NO: 157015 - RNA, 1701 nt, Artificial Sequence
  derived and/or modified sequence opt4 from hemagglutinin__InfluenzaA__ADE29041
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagaagaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157016 - RNA, 1701 nt, Artificial Sequence; identical to SEQ ID NO: 156838
  derived and/or modified sequence opt4 from hemagglutinin__InfluenzaA__ADE29051

SEQ ID NO: 157017 - RNA, 1701 nt, Artificial Sequence
  derived and/or modified sequence opt4 from hemagglutinin__InfluenzaA__ADE29085
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccgaggccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaccuucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157018 - RNA, 1701 nt, Artificial Sequence
  derived and/or modified sequence opt4 from hemagglutinin__InfluenzaA__ADE29095
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaccuucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157019 - RNA, 1701 nt, Artificial Sequence; identical to SEQ ID NO: 156108
  derived and/or modified sequence opt4 from hemagglutinin__InfluenzaA__ADE34191

SEQ ID NO: 157020 - RNA, 1701 nt, Artificial Sequence; identical to SEQ ID NO: 156108
  derived and/or modified sequence opt4 from hemagglutinin__InfluenzaA__ADE34202

SEQ ID NO: 157021 - RNA, 1701 nt, Artificial Sequence
  derived and/or modified sequence opt4 from hemagglutinin__InfluenzaA__ADE34213
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagaaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157022 - RNA, 1701 nt, Artificial Sequence; identical to SEQ ID NO: 156108
  derived and/or modified sequence opt4 from hemagglutinin__InfluenzaA__ADE34224

SEQ ID NO: 157023 - RNA, 1701 nt, Artificial Sequence
  derived and/or modified sequence opt4 from hemagglutinin__InfluenzaA__ADE34235
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccaggacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaccaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157024 - RNA, 1701 nt, Artificial Sequence; identical to SEQ ID NO: 156108
  derived and/or modified sequence opt4 from hemagglutinin__InfluenzaA__ADE34246

SEQ ID NO: 157025 - RNA, 1701 nt, Artificial Sequence; identical to SEQ ID NO: 156133
  derived and/or modified sequence opt4 from hemagglutinin__InfluenzaA__ADE34257

SEQ ID NO: 157026 - RNA, 1701 nt, Artificial Sequence
  derived and/or modified sequence opt4 from hemagglutinin__InfluenzaA__ADE34268
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgaggugcccgacuacgccagccugagaagccugguggccagcagcggcacccuggaguucaacaacgagagcuucaacuggaccggcgugacccaggacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157027 - RNA, 1701 nt, Artificial Sequence
  derived and/or modified sequence opt4 from hemagglutinin__InfluenzaA__ADE45499
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucaagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157028 - RNA, 1701 nt, Artificial Sequence; identical to SEQ ID NO: 155987
  derived and/or modified sequence opt4 from hemagglutinin__InfluenzaA__ADE45501

SEQ ID NO: 157029 - RNA, 1701 nt, Artificial Sequence
  derived and/or modified sequence opt4 from hemagglutinin__InfluenzaA__ADE45503
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaguguaccagauccuggccaucuacagcaccguggccagcagccuggugcugguggugagccugggcgccaucagcuucuggaugugcagcaacggcagccugcagugcagaaucugcaucuga

SEQ ID NO: 157030 - RNA, 1701 nt, Artificial Sequence; identical to SEQ ID NO: 155189
  derived and/or modified sequence opt4 from hemagglutinin__InfluenzaA__ADE45505

SEQ ID NO: 157031 - RNA, 1701 nt, Artificial Sequence; identical to SEQ ID NO: 155542
  derived and/or modified sequence opt4 from hemagglutinin__InfluenzaA__ADE45507

SEQ ID NO: 157032 - RNA, 1701 nt, Artificial Sequence; identical to SEQ ID NO: 155542
  derived and/or modified sequence opt4 from hemagglutinin__InfluenzaA__ADE45509

SEQ ID NO: 157033 - RNA, 1701 nt, Artificial Sequence; identical to SEQ ID NO: 155987
  derived and/or modified sequence opt4 from hemagglutinin__InfluenzaA__ADE45511

SEQ ID NO: 157034 - RNA, 1701 nt, Artificial Sequence
  derived and/or modified sequence opt4 from hemagglutinin__InfluenzaA__ADE45513
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacgccuucgugggcaccagcagauacagcaagaaguucaagcccgagaucgccaucagacccaaggugagagaccaggagggcagaaucaacuacuacuggacccugguggagcccggcgacaagaucaucuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157035 - RNA, 1701 nt, Artificial Sequence
  derived and/or modified sequence opt4 from hemagglutinin__InfluenzaA__ADE75388
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgagaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157036 - RNA, 1701 nt, Artificial Sequence; identical to SEQ ID NO: 155189
  derived and/or modified sequence opt4 from hemagglutinin__InfluenzaA__ADE75390

SEQ ID NO: 157037 - RNA, 1701 nt, Artificial Sequence; identical to SEQ ID NO: 155189
  derived and/or modified sequence opt4 from hemagglutinin__InfluenzaA__ADF10067

SEQ ID NO: 157038 - RNA, 1701 nt, Artificial Sequence; identical to SEQ ID NO: 155189
  derived and/or modified sequence opt4 from hemagglutinin__InfluenzaA__ADF10077

SEQ ID NO: 157039 - RNA, 1701 nt, Artificial Sequence
  derived and/or modified sequence opt4 from hemagglutinin__InfluenzaA__ADF10087
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccaugaagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157040 - RNA, 1701 nt, Artificial Sequence
  derived and/or modified sequence opt4 from hemagglutinin__InfluenzaA__ADF10097
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccaagaucuaccagauccuggccaucuacagcaccguggccagcagccuggugcugguggugagccugggcgccaucagcuucuggaugugcagcaacggcagccugcagugcagaaucugcaucuga

SEQ ID NO: 157041 - RNA, 1701 nt, Artificial Sequence
  derived and/or modified sequence opt4 from hemagglutinin__InfluenzaA__ADF10107
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcagcagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccaagaucuaccagauccuggccaucuacagcaccguggccagcagccuggugcugguggugagccugggcgccaucagcuucuggaugugcagcaacggcagccugcagugcagaaucugcaucuga

SEQ ID NO: 157042 - RNA, 1701 nt, Artificial Sequence; identical to SEQ ID NO: 155189
  derived and/or modified sequence opt4 from hemagglutinin__InfluenzaA__ADF10117

SEQ ID NO: 157043 - RNA, 1701 nt, Artificial Sequence; identical to SEQ ID NO: 156893
  derived and/or modified sequence opt4 from hemagglutinin__InfluenzaA__ADF10127

SEQ ID NO: 157044 - RNA, 1701 nt, Artificial Sequence; identical to SEQ ID NO: 155189
  derived and/or modified sequence opt4 from hemagglutinin__InfluenzaA__ADF10137

SEQ ID NO: 157045 - RNA, 1701 nt, Artificial Sequence
  derived and/or modified sequence opt4 from hemagglutinin__InfluenzaA__ADF10154
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagagagugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157046 - RNA, 1701 nt, Artificial Sequence
  derived and/or modified sequence opt4 from hemagglutinin__InfluenzaA__ADF10174
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagagagugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157047 - RNA, 1701 nt, Artificial Sequence; identical to SEQ ID NO: 157046
  derived and/or modified sequence opt4 from hemagglutinin__InfluenzaA__ADF10190

SEQ ID NO: 157048 - RNA, 1701 nt, Artificial Sequence; identical to SEQ ID NO: 156893
  derived and/or modified sequence opt4 from hemagglutinin__InfluenzaA__ADF10237

SEQ ID NO: 157049 - RNA, 1701 nt, Artificial Sequence; identical to SEQ ID NO: 157046
  derived and/or modified sequence opt4 from hemagglutinin__InfluenzaA__ADF10262

SEQ ID NO: 157050 - RNA, 1701 nt, Artificial Sequence
  derived and/or modified sequence opt4 from hemagglutinin__InfluenzaA__ADF10288
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagagagugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagagugugcaucuga

SEQ ID NO: 157051 - RNA, 1701 nt, Artificial Sequence; identical to SEQ ID NO: 156893
  derived and/or modified sequence opt4 from hemagglutinin__InfluenzaA__ADF10302

SEQ ID NO: 157052 - RNA, 1701 nt, Artificial Sequence; identical to SEQ ID NO: 156893
  derived and/or modified sequence opt4 from hemagglutinin__InfluenzaA__ADF10335

SEQ ID NO: 157053 - RNA, 1701 nt, Artificial Sequence; identical to SEQ ID NO: 156893
  derived and/or modified sequence opt4 from hemagglutinin__InfluenzaA__ADF10359

SEQ ID NO: 157054 - RNA, 1701 nt, Artificial Sequence; identical to SEQ ID NO: 157046
  derived and/or modified sequence opt4 from hemagglutinin__InfluenzaA__ADF10369

SEQ ID NO: 157055 - RNA, 1701 nt, Artificial Sequence; identical to SEQ ID NO: 157046
  derived and/or modified sequence opt4 from hemagglutinin__InfluenzaA__ADF10390

SEQ ID NO: 157056 - RNA, 1701 nt, Artificial Sequence; identical to SEQ ID NO: 156893
  derived and/or modified sequence opt4 from hemagglutinin__InfluenzaA__ADF10528

SEQ ID NO: 157057 - RNA, 1701 nt, Artificial Sequence; identical to SEQ ID NO: 157046
  derived and/or modified sequence opt4 from hemagglutinin__InfluenzaA__ADF10598

SEQ ID NO: 157058 - RNA, 1701 nt, Artificial Sequence; identical to SEQ ID NO: 157046
  derived and/or modified sequence opt4 from hemagglutinin__InfluenzaA__ADF10670

SEQ ID NO: 157059 - RNA, 1701 nt, Artificial Sequence; identical to SEQ ID NO: 157046
  derived and/or modified sequence opt4 from hemagglutinin__InfluenzaA__ADF10724

SEQ ID NO: 157060 - RNA, 1701 nt, Artificial Sequence; identical to SEQ ID NO: 156893
  derived and/or modified sequence opt4 from hemagglutinin__InfluenzaA__ADF10757

SEQ ID NO: 157061 - RNA, 1701 nt, Artificial Sequence
  derived and/or modified sequence opt4 from hemagglutinin__InfluenzaA__ADF10828
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157062 - RNA, 1701 nt, Artificial Sequence; identical to SEQ ID NO: 155189
  derived and/or modified sequence opt4 from hemagglutinin__InfluenzaA__ADF10874

SEQ ID NO: 157063 - RNA, 1701 nt, Artificial Sequence; identical to SEQ ID NO: 155812
  derived and/or modified sequence opt4 from hemagglutinin__InfluenzaA__ADF10929

SEQ ID NO: 157064 - RNA, 1701 nt, Artificial Sequence; identical to SEQ ID NO: 155812
  derived and/or modified sequence opt4 from hemagglutinin__InfluenzaA__ADF10996

SEQ ID NO: 157065 - RNA, 1701 nt, Artificial Sequence; identical to SEQ ID NO: 155189
  derived and/or modified sequence opt4 from hemagglutinin__InfluenzaA__ADF27367

SEQ ID NO: 157066 - RNA, 1701 nt, Artificial Sequence; identical to SEQ ID NO: 155189
  derived and/or modified sequence opt4 from hemagglutinin__InfluenzaA__ADF27369

SEQ ID NO: 157067 - RNA, 1701 nt, Artificial Sequence
  derived and/or modified sequence opt4 from hemagglutinin__InfluenzaA__ADF27370
augaaggccauccuggugauccugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacgugcuggugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157068 - RNA, 1701 nt, Artificial Sequence; identical to SEQ ID NO: 156361
  derived and/or modified sequence opt4 from hemagglutinin__InfluenzaA__ADF27371

SEQ ID NO: 157069 - RNA, 1701 nt, Artificial Sequence
  derived and/or modified sequence opt4 from hemagglutinin__InfluenzaA__ADF27372
augaaggccauccugguggugcugcuguacaccuucgccaccgccaacgccgacacccugugcaucggcuaccacaccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157070 - RNA, 1701 nt, Artificial Sequence
  derived and/or modified sequence opt4 from hemagglutinin__InfluenzaA__ADF27373
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugaucgagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagaccagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157071 - RNA, 1701 nt, Artificial Sequence; identical to SEQ ID NO: 155431
  derived and/or modified sequence opt4 from hemagglutinin__InfluenzaA__ADF27374

SEQ ID NO: 157072 - RNA, 1701 nt, Artificial Sequence
  derived and/or modified sequence opt4 from hemagglutinin__InfluenzaA__ADF27375
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucgacgagaucaccaacaagaucaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157073 - RNA, 1701 nt, Artificial Sequence
  derived and/or modified sequence opt4 from hemagglutinin__InfluenzaA__ADF27376
augaaggccauccugguggugcugcuguacaccuucgugaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgagaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157074 - RNA, 1701 nt, Artificial Sequence
  derived and/or modified sequence opt4 from hemagglutinin__InfluenzaA__ADF27378
augaaggccauccugguggugcugcuguacaccuucgugaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157075 - RNA, 1701 nt, Artificial Sequence
  derived and/or modified sequence opt4 from hemagglutinin__InfluenzaA__ADF27389
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaccagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157076 - RNA, 1701 nt, Artificial Sequence
  derived and/or modified sequence opt4 from hemagglutinin__InfluenzaA__ADF27399
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcgagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157077 - RNA, 1701 nt, Artificial Sequence; identical to SEQ ID NO: 156353
  derived and/or modified sequence opt4 from hemagglutinin__InfluenzaA__ADF27409

SEQ ID NO: 157078 - RNA, 1701 nt, Artificial Sequence; identical to SEQ ID NO: 157061
  derived and/or modified sequence opt4 from hemagglutinin__InfluenzaA__ADF27419

SEQ ID NO: 157079 - RNA, 1701 nt, Artificial Sequence
  derived and/or modified sequence opt4 from hemagglutinin__InfluenzaA__ADF27429
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaaguucuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcaugaagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157080 - RNA, 1701 nt, Artificial Sequence; identical to SEQ ID NO: 155189
  derived and/or modified sequence opt4 from hemagglutinin__InfluenzaA__ADF27439

SEQ ID NO: 157081 - RNA, 1701 nt, Artificial Sequence
  derived and/or modified sequence opt4 from hemagglutinin__InfluenzaA__ADF27449
augaaggccauccugguggugcugcuguacaccuucgccaccgugaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157082 - RNA, 1701 nt, Artificial Sequence; identical to SEQ ID NO: 156349
  derived and/or modified sequence opt4 from hemagglutinin__InfluenzaA__ADF27459

SEQ ID NO: 157083 - RNA, 1701 nt, Artificial Sequence; identical to SEQ ID NO: 155189
  derived and/or modified sequence opt4 from hemagglutinin__InfluenzaA__ADF27469

SEQ ID NO: 157084 - RNA, 1701 nt, Artificial Sequence
  derived and/or modified sequence opt4 from hemagglutinin__InfluenzaA__ADF27479
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccacagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157085 - RNA, 1701 nt, Artificial Sequence
  derived and/or modified sequence opt4 from hemagglutinin__InfluenzaA__ADF27489
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaguacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcgagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157086 - RNA, 1701 nt, Artificial Sequence; identical to SEQ ID NO: 156353
  derived and/or modified sequence opt4 from hemagglutinin__InfluenzaA__ADF27499

SEQ ID NO: 157087 - RNA, 1701 nt, Artificial Sequence; identical to SEQ ID NO: 155189
  derived and/or modified sequence opt4 from hemagglutinin__InfluenzaA__ADF27509

SEQ ID NO: 157088 - RNA, 1701 nt, Artificial Sequence; identical to SEQ ID NO: 156786
  derived and/or modified sequence opt4 from hemagglutinin__InfluenzaA__ADF27529

SEQ ID NO: 157089 - RNA, 1701 nt, Artificial Sequence; identical to SEQ ID NO: 156361
  derived and/or modified sequence opt4 from hemagglutinin__InfluenzaA__ADF27539

SEQ ID NO: 157090 - RNA, 1701 nt, Artificial Sequence; identical to SEQ ID NO: 156361
  derived and/or modified sequence opt4 from hemagglutinin__InfluenzaA__ADF27549

SEQ ID NO: 157091 - RNA, 1701 nt, Artificial Sequence; identical to SEQ ID NO: 155189
  derived and/or modified sequence opt4 from hemagglutinin__InfluenzaA__ADF27559

SEQ ID NO: 157092 - RNA, 1701 nt, Artificial Sequence
  derived and/or modified sequence opt4 from hemagglutinin__InfluenzaA__ADF27569
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagagugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157093 - RNA, 1701 nt, Artificial Sequence; identical to SEQ ID NO: 156361
  derived and/or modified sequence opt4 from hemagglutinin__InfluenzaA__ADF27579

SEQ ID NO: 157094 - RNA, 1701 nt, Artificial Sequence
  derived and/or modified sequence opt4 from hemagglutinin__InfluenzaA__ADF27589
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccagcgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157095 - RNA, 1701 nt, Artificial Sequence
  derived and/or modified sequence opt4 from hemagglutinin__InfluenzaA__ADF27599
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagagcaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157096 - RNA, 1701 nt, Artificial Sequence
  derived and/or modified sequence opt4 from hemagglutinin__InfluenzaA__ADF27609
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccaggccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157097 - RNA, 1701 nt, Artificial Sequence
  derived and/or modified sequence opt4 from hemagglutinin__InfluenzaA__ADF27619
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggugccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157098 - RNA, 1701 nt, Artificial Sequence; identical to SEQ ID NO: 156361
  derived and/or modified sequence opt4 from hemagglutinin__InfluenzaA__ADF27629

SEQ ID NO: 157099 - RNA, 1701 nt, Artificial Sequence
  derived and/or modified sequence opt4 from hemagglutinin__InfluenzaA__ADF27649
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagcccagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157100 - RNA, 1701 nt, Artificial Sequence; identical to SEQ ID NO: 156361
  derived and/or modified sequence opt4 from hemagglutinin__InfluenzaA__ADF27659

SEQ ID NO: 157101 - RNA, 1701 nt, Artificial Sequence; identical to SEQ ID NO: 156838
  derived and/or modified sequence opt4 from hemagglutinin__InfluenzaA__ADF27669

SEQ ID NO: 157102 - RNA, 1701 nt, Artificial Sequence; identical to SEQ ID NO: 156290
  derived and/or modified sequence opt4 from hemagglutinin__InfluenzaA__ADF27679

SEQ ID NO: 157103 - RNA, 1701 nt, Artificial Sequence; identical to SEQ ID NO: 156899
  derived and/or modified sequence opt4 from hemagglutinin__InfluenzaA__ADF27689

SEQ ID NO: 157104 - RNA, 1701 nt, Artificial Sequence
  derived and/or modified sequence opt4 from hemagglutinin__InfluenzaA__ADF27699
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157105 - RNA, 1701 nt, Artificial Sequence
  derived and/or modified sequence opt4 from hemagglutinin__InfluenzaA__ADF27709
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaucagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157106 - RNA, 1701 nt, Artificial Sequence; identical to SEQ ID NO: 156353
  derived and/or modified sequence opt4 from hemagglutinin__InfluenzaA__ADF27785

SEQ ID NO: 157107 - RNA, 1701 nt, Artificial Sequence
  derived and/or modified sequence opt4 from hemagglutinin__InfluenzaA__ADF27795
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccuggugaagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157108 - RNA, 1701 nt, Artificial Sequence; identical to SEQ ID NO: 156361
  derived and/or modified sequence opt4 from hemagglutinin__InfluenzaA__ADF27805

SEQ ID NO: 157109 - RNA, 1701 nt, Artificial Sequence
  derived and/or modified sequence opt4 from hemagglutinin__InfluenzaA__ADF27815
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgacggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157110 - RNA, 1701 nt, Artificial Sequence
  derived and/or modified sequence opt4 from hemagglutinin__InfluenzaA__ADF27825
augaaggccauccugguggugcugcuguacaccuucgccaccgccaacgccgacacccugugcaucggcuaccacgccaacaacagcaccgacaccguggacaccgugcuggagagaaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacagcgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157111 - RNA, 1701 nt, Artificial Sequence
  derived and/or modified sequence opt4 from hemagglutinin__InfluenzaA__ADF27845
augaaggccauccugguggugcugcuguacaccuucgccaccgccaacgccgacacccugugcaucggcuaccacgccaacaacagcaccgacaccguggacaccgugcuggagaagaacgugaccgugacccacagcgccaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaacgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157112 - RNA, 1701 nt, Artificial Sequence; identical to SEQ ID NO: 156353
  derived and/or modified sequence opt4 from hemagglutinin__InfluenzaA__ADF27855

SEQ ID NO: 157113 - RNA, 1701 nt, Artificial Sequence; identical to SEQ ID NO: 156353
  derived and/or modified sequence opt4 from hemagglutinin__InfluenzaA__ADF27865

SEQ ID NO: 157114 - RNA, 1701 nt, Artificial Sequence; identical to SEQ ID NO: 156353
  derived and/or modified sequence opt4 from hemagglutinin__InfluenzaA__ADF27875

SEQ ID NO: 157115 - RNA, 1701 nt, Artificial Sequence; identical to SEQ ID NO: 156353
  derived and/or modified sequence opt4 from hemagglutinin__InfluenzaA__ADF27885

SEQ ID NO: 157116 - RNA, 1701 nt, Artificial Sequence; identical to SEQ ID NO: 155189
  derived and/or modified sequence opt4 from hemagglutinin__InfluenzaA__ADF27895

SEQ ID NO: 157117 - RNA, 1701 nt, Artificial Sequence
  derived and/or modified sequence opt4 from hemagglutinin__InfluenzaA__ADF27915
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcgccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157118 - RNA, 1701 nt, Artificial Sequence
  derived and/or modified sequence opt4 from hemagglutinin__InfluenzaA__ADF27925
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaacagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacauccaccccaucaccaucggcaagugccccaaguacgugaagagcaccaagcugagaauggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157119 - RNA, 1701 nt, Artificial Sequence
  derived and/or modified sequence opt4 from hemagglutinin__InfluenzaA__ADF27935
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccaagugcgagagccugagcaccgagagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157120 - RNA, 1701 nt, Artificial Sequence
  derived and/or modified sequence opt4 from hemagglutinin__InfluenzaA__ADF27955
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaacagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157121 - RNA, 1701 nt, Artificial Sequence
  derived and/or modified sequence opt4 from hemagglutinin__InfluenzaA__ADF27965
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaagaaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugaacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157122 - RNA, 1701 nt, Artificial Sequence; identical to SEQ ID NO: 156353
  derived and/or modified sequence opt4 from hemagglutinin__InfluenzaA__ADF27975

SEQ ID NO: 157123 - RNA, 1701 nt, Artificial Sequence; identical to SEQ ID NO: 156361
  derived and/or modified sequence opt4 from hemagglutinin__InfluenzaA__ADF27985

SEQ ID NO: 157124 - RNA, 1701 nt, Artificial Sequence
  derived and/or modified sequence opt4 from hemagglutinin__InfluenzaA__ADF27995
augaaggccauccugguggugcugcuguacaccuucgccaccgccaacgccgacacccugugcaucggcuaccacgccaacaacagcaccgacaccguggacaccgugcuggagaagaacgugaccgugacccacagcgccaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccaacgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157125 - RNA, 1701 nt, Artificial Sequence; identical to SEQ ID NO: 156741
  derived and/or modified sequence opt4 from hemagglutinin__InfluenzaA__ADF28005

SEQ ID NO: 157126 - RNA, 1701 nt, Artificial Sequence; identical to SEQ ID NO: 156741
  derived and/or modified sequence opt4 from hemagglutinin__InfluenzaA__ADF28015

SEQ ID NO: 157127 - RNA, 1701 nt, Artificial Sequence; identical to SEQ ID NO: 156353
  derived and/or modified sequence opt4 from hemagglutinin__InfluenzaA__ADF28025

SEQ ID NO: 157128 - RNA, 1701 nt, Artificial Sequence; identical to SEQ ID NO: 156353
  derived and/or modified sequence opt4 from hemagglutinin__InfluenzaA__ADF28045

SEQ ID NO: 157129 - RNA, 1701 nt, Artificial Sequence
  derived and/or modified sequence opt4 from hemagglutinin__InfluenzaA__ADF28055
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaacuacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157130 - RNA, 1701 nt, Artificial Sequence; identical to SEQ ID NO: 156353
  derived and/or modified sequence opt4 from hemagglutinin__InfluenzaA__ADF28065

SEQ ID NO: 157131 - RNA, 1701 nt, Artificial Sequence; identical to SEQ ID NO: 155371
  derived and/or modified sequence opt4 from hemagglutinin__InfluenzaA__ADF28075

SEQ ID NO: 157132 - RNA, 1701 nt, Artificial Sequence; identical to SEQ ID NO: 156290
  derived and/or modified sequence opt4 from hemagglutinin__InfluenzaA__ADF28085

SEQ ID NO: 157133 - RNA, 1701 nt, Artificial Sequence; identical to SEQ ID NO: 155369
  derived and/or modified sequence opt4 from hemagglutinin__InfluenzaA__ADF28107

SEQ ID NO: 157134 - RNA, 1701 nt, Artificial Sequence; identical to SEQ ID NO: 156741
  derived and/or modified sequence opt4 from hemagglutinin__InfluenzaA__ADF28117

SEQ ID NO: 157135 - RNA, 1701 nt, Artificial Sequence
  derived and/or modified sequence opt4 from hemagglutinin__InfluenzaA__ADF29918
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcagaagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaaaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157136 - RNA, 1701 nt, Artificial Sequence
  derived and/or modified sequence opt4 from hemagglutinin__InfluenzaA__ADF42689
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcuggccgugagccugggcgccaucggcuucuggaugugcagcaacggcagccugcagugcagaaucugcaucuga

SEQ ID NO: 157137 - RNA, 1701 nt, Artificial Sequence
  derived and/or modified sequence opt4 from hemagglutinin__InfluenzaA__ADF42699
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcacccugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157138 - RNA, 1701 nt, Artificial Sequence; identical to SEQ ID NO: 156353
  derived and/or modified sequence opt4 from hemagglutinin__InfluenzaA__ADF42709

SEQ ID NO: 157139 - RNA, 1701 nt, Artificial Sequence; identical to SEQ ID NO: 156353
  derived and/or modified sequence opt4 from hemagglutinin__InfluenzaA__ADF42719

SEQ ID NO: 157140 - RNA, 1701 nt, Artificial Sequence; identical to SEQ ID NO: 156353
  derived and/or modified sequence opt4 from hemagglutinin__InfluenzaA__ADF42729

SEQ ID NO: 157141 - RNA, 1701 nt, Artificial Sequence; identical to SEQ ID NO: 156353
  derived and/or modified sequence opt4 from hemagglutinin__InfluenzaA__ADF42739

SEQ ID NO: 157142 - RNA, 1701 nt, Artificial Sequence
  derived and/or modified sequence opt4 from hemagglutinin__InfluenzaA__ADF58349
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157143 - RNA, 1701 nt, Artificial Sequence; identical to SEQ ID NO: 156786
  derived and/or modified sequence opt4 from hemagglutinin__InfluenzaA__ADF58351

SEQ ID NO: 157144 - RNA, 1701 nt, Artificial Sequence
  derived and/or modified sequence opt4 from hemagglutinin__InfluenzaA__ADF80454
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcaucaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157145 - RNA, 1701 nt, Artificial Sequence
  derived and/or modified sequence opt4 from hemagglutinin__InfluenzaA__ADF80462
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucgacuacgaggagcugagagagcagcugagcagcgugagcagcuucgagagauucgagaucuuccccaagaucagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157146 - RNA, 1701 nt, Artificial Sequence; identical to SEQ ID NO: 155189
  derived and/or modified sequence opt4 from hemagglutinin__InfluenzaA__ADF80470

SEQ ID NO: 157147 - RNA, 1701 nt, Artificial Sequence
  derived and/or modified sequence opt4 from hemagglutinin__InfluenzaA__ADF80478
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugauggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157148 - RNA, 1701 nt, Artificial Sequence
  derived and/or modified sequence opt4 from hemagglutinin__InfluenzaA__ADF80494
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaccaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157149 - RNA, 1701 nt, Artificial Sequence; identical to SEQ ID NO: 157148
  derived and/or modified sequence opt4 from hemagglutinin__InfluenzaA__ADF80498

SEQ ID NO: 157150 - RNA, 1701 nt, Artificial Sequence; identical to SEQ ID NO: 155813
  derived and/or modified sequence opt4 from hemagglutinin__InfluenzaA__ADF80502

SEQ ID NO: 157151 - RNA, 1701 nt, Artificial Sequence
  derived and/or modified sequence opt4 from hemagglutinin__InfluenzaA__ADF80506
augaaggccauccugguggugcugcuguacaccuucgccaccgccaacgccgacacccugugcaucggcuaccacgccaacaacagcaccgacaccguggacaccgugcuggagagaaacgugaccgugacccacagcgugaaccugcuggaggacaagcacaacggcaagcugugcaagcugagaggcguggccccccugcaccugggcaagugcagcaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaaggagaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157152 - RNA, 1701 nt, Artificial Sequence
  derived and/or modified sequence opt4 from hemagglutinin__InfluenzaA__ADF83741
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcgugaugagaagcgacgcccccaucggcaagugcaacagcgacugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157153 - RNA, 1701 nt, Artificial Sequence; identical to SEQ ID NO: 155931
  derived and/or modified sequence opt4 from hemagglutinin__InfluenzaA__ADF83752

SEQ ID NO: 157154 - RNA, 1701 nt, Artificial Sequence; identical to SEQ ID NO: 156741
  derived and/or modified sequence opt4 from hemagglutinin__InfluenzaA__ADF83763

SEQ ID NO: 157155 - RNA, 1701 nt, Artificial Sequence; identical to SEQ ID NO: 156741
  derived and/or modified sequence opt4 from hemagglutinin__InfluenzaA__ADF83773

SEQ ID NO: 157156 - RNA, 1701 nt, Artificial Sequence
  derived and/or modified sequence opt4 from hemagglutinin__InfluenzaA__ADF83783
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaccaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157157 - RNA, 1701 nt, Artificial Sequence; identical to SEQ ID NO: 156816
  derived and/or modified sequence opt4 from hemagglutinin__InfluenzaA__ADF83793

SEQ ID NO: 157158 - RNA, 1701 nt, Artificial Sequence
  derived and/or modified sequence opt4 from hemagglutinin__InfluenzaA__ADF83803
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagacccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaccggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157159 - RNA, 1701 nt, Artificial Sequence
  derived and/or modified sequence opt4 from hemagglutinin__InfluenzaA__ADF83813
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157160 - RNA, 1701 nt, Artificial Sequence
  derived and/or modified sequence opt4 from hemagglutinin__InfluenzaA__ADF83823
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacagcuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157161 - RNA, 1701 nt, Artificial Sequence; identical to SEQ ID NO: 156741
  derived and/or modified sequence opt4 from hemagglutinin__InfluenzaA__ADF83833

SEQ ID NO: 157162 - RNA, 1701 nt, Artificial Sequence; identical to SEQ ID NO: 156741
  derived and/or modified sequence opt4 from hemagglutinin__InfluenzaA__ADF83843

SEQ ID NO: 157163 - RNA, 1701 nt, Artificial Sequence; identical to SEQ ID NO: 156741
  derived and/or modified sequence opt4 from hemagglutinin__InfluenzaA__ADF83853

SEQ ID NO: 157164 - RNA, 1701 nt, Artificial Sequence
  derived and/or modified sequence opt4 from hemagglutinin__InfluenzaA__ADF83873
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccaacagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157165 - RNA, 1701 nt, Artificial Sequence; identical to SEQ ID NO: 156353
  derived and/or modified sequence opt4 from hemagglutinin__InfluenzaA__ADF83885

SEQ ID NO: 157166 - RNA, 1701 nt, Artificial Sequence
  derived and/or modified sequence opt4 from hemagglutinin__InfluenzaA__ADF83895
augaaggccauccugguggugcugcuguacaccuucgccaccgugaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaagaucagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157167 - RNA, 1701 nt, Artificial Sequence; identical to SEQ ID NO: 156741
  derived and/or modified sequence opt4 from hemagglutinin__InfluenzaA__ADF83915

SEQ ID NO: 157168 - RNA, 1701 nt, Artificial Sequence
  derived and/or modified sequence opt4 from hemagglutinin__InfluenzaA__ADF84441
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccagccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacauccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157169 - RNA, 1701 nt, Artificial Sequence; identical to SEQ ID NO: 156353
  derived and/or modified sequence opt4 from hemagglutinin__InfluenzaA__ADF84459

SEQ ID NO: 157170 - RNA, 1701 nt, Artificial Sequence; identical to SEQ ID NO: 156741
  derived and/or modified sequence opt4 from hemagglutinin__InfluenzaA__ADF84469

SEQ ID NO: 157171 - RNA, 1701 nt, Artificial Sequence; identical to SEQ ID NO: 156802
  derived and/or modified sequence opt4 from hemagglutinin__InfluenzaA__ADF84479

SEQ ID NO: 157172 - RNA, 1701 nt, Artificial Sequence; identical to SEQ ID NO: 156741
  derived and/or modified sequence opt4 from hemagglutinin__InfluenzaA__ADF84489

SEQ ID NO: 157173 - RNA, 1701 nt, Artificial Sequence; identical to SEQ ID NO: 156741
  derived and/or modified sequence opt4 from hemagglutinin__InfluenzaA__ADF85017

SEQ ID NO: 157174 - RNA, 1701 nt, Artificial Sequence; identical to SEQ ID NO: 156741
  derived and/or modified sequence opt4 from hemagglutinin__InfluenzaA__ADF87152

SEQ ID NO: 157175 - RNA, 1701 nt, Artificial Sequence
  derived and/or modified sequence opt4 from hemagglutinin__InfluenzaA__ADF87162
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacagcuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157176 - RNA, 1701 nt, Artificial Sequence; identical to SEQ ID NO: 156741
  derived and/or modified sequence opt4 from hemagglutinin__InfluenzaA__ADF87172

SEQ ID NO: 157177 - RNA, 1701 nt, Artificial Sequence
  derived and/or modified sequence opt4 from hemagglutinin__InfluenzaA__ADF87182
augaacgccauccugguggugcugcuguacaccuucgccaccgccaacgccgacacccugugcaucggcuaccacgccaacaacagcaccgacaccguggacacccugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuaccacuggacccugguggagcccggcgacaagaucaccuucgaggccaccggcaaccugguggugcccagauacgccuucgccauggagagaaacgccggcagcggcaucaucaucagcgacgcccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaagaucaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157178 - RNA, 1701 nt, Artificial Sequence; identical to SEQ ID NO: 156741
  derived and/or modified sequence opt4 from hemagglutinin__InfluenzaA__ADF87192

SEQ ID NO: 157179 - RNA, 1701 nt, Artificial Sequence
  derived and/or modified sequence opt4 from hemagglutinin__InfluenzaA__ADF87202
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuucgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157180 - RNA, 1701 nt, Artificial Sequence; identical to SEQ ID NO: 156741
  derived and/or modified sequence opt4 from hemagglutinin__InfluenzaA__ADF87212

SEQ ID NO: 157181 - RNA, 1701 nt, Artificial Sequence; identical to SEQ ID NO: 156904
  derived and/or modified sequence opt4 from hemagglutinin__InfluenzaA__ADF87232

SEQ ID NO: 157182 - RNA, 1701 nt, Artificial Sequence; identical to SEQ ID NO: 156741
  derived and/or modified sequence opt4 from hemagglutinin__InfluenzaA__ADF87242

SEQ ID NO: 157183 - RNA, 1701 nt, Artificial Sequence
  derived and/or modified sequence opt4 from hemagglutinin__InfluenzaA__ADF87252
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaagagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157184 - RNA, 1701 nt, Artificial Sequence; identical to SEQ ID NO: 156741
  derived and/or modified sequence opt4 from hemagglutinin__InfluenzaA__ADF87262

SEQ ID NO: 157185 - RNA, 1701 nt, Artificial Sequence; identical to SEQ ID NO: 156353
  derived and/or modified sequence opt4 from hemagglutinin__InfluenzaA__ADF87272

SEQ ID NO: 157186 - RNA, 1701 nt, Artificial Sequence; identical to SEQ ID NO: 156353
  derived and/or modified sequence opt4 from hemagglutinin__InfluenzaA__ADF87282

SEQ ID NO: 157187 - RNA, 1701 nt, Artificial Sequence
  derived and/or modified sequence opt4 from hemagglutinin__InfluenzaA__ADF87292
augaaggccauccugguggugcugcuguacaccuucgccaccgccaacgccgacacccugugcaucggcuaccacgccaacaacagcaccgacaccguggacaccgugcugaagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccggcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaugugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157188 - RNA, 1701 nt, Artificial Sequence; identical to SEQ ID NO: 156353
  derived and/or modified sequence opt4 from hemagglutinin__InfluenzaA__ADF87302

SEQ ID NO: 157189 - RNA, 1701 nt, Artificial Sequence
  derived and/or modified sequence opt4 from hemagglutinin__InfluenzaA__ADF87331
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcaucaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157190 - RNA, 1701 nt, Artificial Sequence; identical to SEQ ID NO: 155189
  derived and/or modified sequence opt4 from hemagglutinin__InfluenzaA__ADF87341

SEQ ID NO: 157191 - RNA, 1701 nt, Artificial Sequence
  derived and/or modified sequence opt4 from hemagglutinin__InfluenzaA__ADF87351
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgacagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157192 - RNA, 1701 nt, Artificial Sequence; identical to SEQ ID NO: 156816
  derived and/or modified sequence opt4 from hemagglutinin__InfluenzaA__ADF87361

SEQ ID NO: 157193 - RNA, 1701 nt, Artificial Sequence; identical to SEQ ID NO: 156353
  derived and/or modified sequence opt4 from hemagglutinin__InfluenzaA__ADF87371

SEQ ID NO: 157194 - RNA, 1701 nt, Artificial Sequence
  derived and/or modified sequence opt4 from hemagglutinin__InfluenzaA__ADG08115
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157195 - RNA, 1701 nt, Artificial Sequence; identical to SEQ ID NO: 155931
  derived and/or modified sequence opt4 from hemagglutinin__InfluenzaA__ADG21004

SEQ ID NO: 157196 - RNA, 1701 nt, Artificial Sequence; identical to SEQ ID NO: 155931
  derived and/or modified sequence opt4 from hemagglutinin__InfluenzaA__ADG21006

SEQ ID NO: 157197 - RNA, 1701 nt, Artificial Sequence
  derived and/or modified sequence opt4 from hemagglutinin__InfluenzaA__ADG21008
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaagagcuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaaagagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157198 - RNA, 1701 nt, Artificial Sequence
  derived and/or modified sequence opt4 from hemagglutinin__InfluenzaA__ADG21009
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugagauucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157199 - RNA, 1701 nt, Artificial Sequence; identical to SEQ ID NO: 155931
  derived and/or modified sequence opt4 from hemagglutinin__InfluenzaA__ADG21010

SEQ ID NO: 157200 - RNA, 1701 nt, Artificial Sequence
  derived and/or modified sequence opt4 from hemagglutinin__InfluenzaA__ADG21011
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157201 - RNA, 1701 nt, Artificial Sequence; identical to SEQ ID NO: 155931
  derived and/or modified sequence opt4 from hemagglutinin__InfluenzaA__ADG21012

SEQ ID NO: 157202 - RNA, 1701 nt, Artificial Sequence; identical to SEQ ID NO: 155931
  derived and/or modified sequence opt4 from hemagglutinin__InfluenzaA__ADG21013

SEQ ID NO: 157203 - RNA, 1701 nt, Artificial Sequence
  derived and/or modified sequence opt4 from hemagglutinin__InfluenzaA__ADG21014
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157204 - RNA, 1701 nt, Artificial Sequence
  derived and/or modified sequence opt4 from hemagglutinin__InfluenzaA__ADG21017
augaagaccaucaucgcccugagcuacauccuguaccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157205 - RNA, 1701 nt, Artificial Sequence
  derived and/or modified sequence opt4 from hemagglutinin__InfluenzaA__ADG21018
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccacagcaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacacagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157206 - RNA, 1701 nt, Artificial Sequence
  derived and/or modified sequence opt4 from hemagglutinin__InfluenzaA__ADG21019
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacacccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcaagaucaucgugagcaccaagagaagccagcagaccgugauccccaacaucggcagcagacccagagugagaaacauccccagcaucaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaucggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157207 - RNA, 1701 nt, Artificial Sequence
  derived and/or modified sequence opt4 from hemagglutinin__InfluenzaA__ADG21020
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagagcggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaucgugagcaccaagagaagccagcagaccgugacccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157208 - RNA, 1701 nt, Artificial Sequence; identical to SEQ ID NO: 154954
  derived and/or modified sequence opt4 from hemagglutinin__InfluenzaA__ADG21022

SEQ ID NO: 157209 - RNA, 1701 nt, Artificial Sequence; identical to SEQ ID NO: 154954
  derived and/or modified sequence opt4 from hemagglutinin__InfluenzaA__ADG21023

SEQ ID NO: 157210 - RNA, 1701 nt, Artificial Sequence
  derived and/or modified sequence opt4 from hemagglutinin__InfluenzaA__ADG21024
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcgcccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157211 - RNA, 1701 nt, Artificial Sequence
  derived and/or modified sequence opt4 from hemagglutinin__InfluenzaA__ADG21026
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcaggccgugauccccaacaucggcagcagacugagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaccaucuaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157212 - RNA, 1701 nt, Artificial Sequence; identical to SEQ ID NO: 155189
  derived and/or modified sequence opt4 from hemagglutinin__InfluenzaA__ADG21037

SEQ ID NO: 157213 - RNA, 1701 nt, Artificial Sequence
  derived and/or modified sequence opt4 from hemagglutinin__InfluenzaA__ADG21038
augaaggccauccugguggugcugcuguacaccuucgccaccgccgacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157214 - RNA, 1701 nt, Artificial Sequence
  derived and/or modified sequence opt4 from hemagglutinin__InfluenzaA__ADG21040
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaguguaccagauccuggccaucuacagcaccguggccagcagccuggugcugguggugagccugggcgccaucagcuucuggaugugcagcaacggcagccugcagugcagaaucugcaucuga

SEQ ID NO: 157215 - RNA, 1701 nt, Artificial Sequence
  derived and/or modified sequence opt4 from hemagglutinin__InfluenzaA__ADG21041
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccgugagcuucuggaugugcagcaacggcagccugcagugcagaaucugcaucuga

SEQ ID NO: 157216 - RNA, 1701 nt, Artificial Sequence; identical to SEQ ID NO: 156290
  derived and/or modified sequence opt4 from hemagglutinin__InfluenzaA__ADG21042

SEQ ID NO: 157217 - RNA, 1701 nt, Artificial Sequence
  derived and/or modified sequence opt4 from hemagglutinin__InfluenzaA__ADG21043
augaaggccauccugguggugcugcuguacaccuucaccaccgccaacgccgacacccugugcgugggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157218 - RNA, 1701 nt, Artificial Sequence
  derived and/or modified sequence opt4 from hemagglutinin__InfluenzaA__ADG21045
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157219 - RNA, 1701 nt, Artificial Sequence; identical to SEQ ID NO: 157218
  derived and/or modified sequence opt4 from hemagglutinin__InfluenzaA__ADG21046

SEQ ID NO: 157220 - RNA, 1701 nt, Artificial Sequence; identical to SEQ ID NO: 156353
  derived and/or modified sequence opt4 from hemagglutinin__InfluenzaA__ADG21048

SEQ ID NO: 157221 - RNA, 1701 nt, Artificial Sequence
  derived and/or modified sequence opt4 from hemagglutinin__InfluenzaA__ADG21049
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaaaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagaccagcaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157222 - RNA, 1701 nt, Artificial Sequence; identical to SEQ ID NO: 155542
  derived and/or modified sequence opt4 from hemagglutinin__InfluenzaA__ADG21122

SEQ ID NO: 157223 - RNA, 1701 nt, Artificial Sequence; identical to SEQ ID NO: 156353
  derived and/or modified sequence opt4 from hemagglutinin__InfluenzaA__ADG21123

SEQ ID NO: 157224 - RNA, 1701 nt, Artificial Sequence; identical to SEQ ID NO: 155189
  derived and/or modified sequence opt4 from hemagglutinin__InfluenzaA__ADG21124

SEQ ID NO: 157225 - RNA, 1701 nt, Artificial Sequence
  derived and/or modified sequence opt4 from hemagglutinin__InfluenzaA__ADG21125
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucaagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157226 - RNA, 1701 nt, Artificial Sequence; identical to SEQ ID NO: 155176
  derived and/or modified sequence opt4 from hemagglutinin__InfluenzaA__ADG21126

SEQ ID NO: 157227 - RNA, 1701 nt, Artificial Sequence; identical to SEQ ID NO: 155176
  derived and/or modified sequence opt4 from hemagglutinin__InfluenzaA__ADG21127

SEQ ID NO: 157228 - RNA, 1701 nt, Artificial Sequence; identical to SEQ ID NO: 155176
  derived and/or modified sequence opt4 from hemagglutinin__InfluenzaA__ADG21128

SEQ ID NO: 157229 - RNA, 1701 nt, Artificial Sequence; identical to SEQ ID NO: 155176
  derived and/or modified sequence opt4 from hemagglutinin__InfluenzaA__ADG21129

SEQ ID NO: 157230 - RNA, 1701 nt, Artificial Sequence; identical to SEQ ID NO: 155189
  derived and/or modified sequence opt4 from hemagglutinin__InfluenzaA__ADG21130

SEQ ID NO: 157231 - RNA, 1701 nt, Artificial Sequence; identical to SEQ ID NO: 155176
  derived and/or modified sequence opt4 from hemagglutinin__InfluenzaA__ADG21131

SEQ ID NO: 157232 - RNA, 1701 nt, Artificial Sequence; identical to SEQ ID NO: 155176
  derived and/or modified sequence opt4 from hemagglutinin__InfluenzaA__ADG21132

SEQ ID NO: 157233 - RNA, 1701 nt, Artificial Sequence; identical to SEQ ID NO: 155176
  derived and/or modified sequence opt4 from hemagglutinin__InfluenzaA__ADG21133

SEQ ID NO: 157234 - RNA, 1701 nt, Artificial Sequence; identical to SEQ ID NO: 155176
  derived and/or modified sequence opt4 from hemagglutinin__InfluenzaA__ADG21134

SEQ ID NO: 157235 - RNA, 1701 nt, Artificial Sequence; identical to SEQ ID NO: 155176
  derived and/or modified sequence opt4 from hemagglutinin__InfluenzaA__ADG21135

SEQ ID NO: 157236 - RNA, 1701 nt, Artificial Sequence; identical to SEQ ID NO: 155176
  derived and/or modified sequence opt4 from hemagglutinin__InfluenzaA__ADG21136

SEQ ID NO: 157237 - RNA, 1701 nt, Artificial Sequence; identical to SEQ ID NO: 155176
  derived and/or modified sequence opt4 from hemagglutinin__InfluenzaA__ADG21137

SEQ ID NO: 157238 - RNA, 1701 nt, Artificial Sequence; identical to SEQ ID NO: 155176
  derived and/or modified sequence opt4 from hemagglutinin__InfluenzaA__ADG21138

SEQ ID NO: 157239 - RNA, 1701 nt, Artificial Sequence; identical to SEQ ID NO: 155176
  derived and/or modified sequence opt4 from hemagglutinin__InfluenzaA__ADG21139

SEQ ID NO: 157240 - RNA, 1701 nt, Artificial Sequence
  derived and/or modified sequence opt4 from hemagglutinin__InfluenzaA__ADG21140
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcugaugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157241 - RNA, 1701 nt, Artificial Sequence; identical to SEQ ID NO: 155176
  derived and/or modified sequence opt4 from hemagglutinin__InfluenzaA__ADG21141

SEQ ID NO: 157242 - RNA, 1701 nt, Artificial Sequence
  derived and/or modified sequence opt4 from hemagglutinin__InfluenzaA__ADG21142
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgagaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157243 - RNA, 1701 nt, Artificial Sequence; identical to SEQ ID NO: 155176
  derived and/or modified sequence opt4 from hemagglutinin__InfluenzaA__ADG21143

SEQ ID NO: 157244 - RNA, 1701 nt, Artificial Sequence; identical to SEQ ID NO: 155176
  derived and/or modified sequence opt4 from hemagglutinin__InfluenzaA__ADG21144

SEQ ID NO: 157245 - RNA, 1701 nt, Artificial Sequence
  derived and/or modified sequence opt4 from hemagglutinin__InfluenzaA__ADG21145
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaucagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157246 - RNA, 1701 nt, Artificial Sequence; identical to SEQ ID NO: 155176
  derived and/or modified sequence opt4 from hemagglutinin__InfluenzaA__ADG21146

SEQ ID NO: 157247 - RNA, 1701 nt, Artificial Sequence; identical to SEQ ID NO: 155176
  derived and/or modified sequence opt4 from hemagglutinin__InfluenzaA__ADG21147

SEQ ID NO: 157248 - RNA, 1701 nt, Artificial Sequence; identical to SEQ ID NO: 155189
  derived and/or modified sequence opt4 from hemagglutinin__InfluenzaA__ADG21148

SEQ ID NO: 157249 - RNA, 1701 nt, Artificial Sequence; identical to SEQ ID NO: 156290
  derived and/or modified sequence opt4 from hemagglutinin__InfluenzaA__ADG21149

SEQ ID NO: 157250 - RNA, 1701 nt, Artificial Sequence; identical to SEQ ID NO: 156353
  derived and/or modified sequence opt4 from hemagglutinin__InfluenzaA__ADG21150

SEQ ID NO: 157251 - RNA, 1701 nt, Artificial Sequence; identical to SEQ ID NO: 155176
  derived and/or modified sequence opt4 from hemagglutinin__InfluenzaA__ADG21151

SEQ ID NO: 157252 - RNA, 1701 nt, Artificial Sequence; identical to SEQ ID NO: 155176
  derived and/or modified sequence opt4 from hemagglutinin__InfluenzaA__ADG21152

SEQ ID NO: 157253 - RNA, 1701 nt, Artificial Sequence; identical to SEQ ID NO: 155189
  derived and/or modified sequence opt4 from hemagglutinin__InfluenzaA__ADG21153

SEQ ID NO: 157254 - RNA, 1701 nt, Artificial Sequence; identical to SEQ ID NO: 155176
  derived and/or modified sequence opt4 from hemagglutinin__InfluenzaA__ADG21154

SEQ ID NO: 157255 - RNA, 1701 nt, Artificial Sequence; identical to SEQ ID NO: 155176
  derived and/or modified sequence opt4 from hemagglutinin__InfluenzaA__ADG21155

SEQ ID NO: 157256 - RNA, 1701 nt, Artificial Sequence; identical to SEQ ID NO: 156353
  derived and/or modified sequence opt4 from hemagglutinin__InfluenzaA__ADG21156

SEQ ID NO: 157257 - RNA, 1701 nt, Artificial Sequence; identical to SEQ ID NO: 156361
  derived and/or modified sequence opt4 from hemagglutinin__InfluenzaA__ADG21158

SEQ ID NO: 157258 - RNA, 1701 nt, Artificial Sequence
  derived and/or modified sequence opt4 from hemagglutinin__InfluenzaA__ADG21159
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugcuggugagccugggcgccaucagcuucuggaugugcagcaacggcagccugcagugcagaaucugcaucuga

SEQ ID NO: 157259 - RNA, 1701 nt, Artificial Sequence; identical to SEQ ID NO: 156361
  derived and/or modified sequence opt4 from hemagglutinin__InfluenzaA__ADG21160

SEQ ID NO: 157260 - RNA, 1701 nt, Artificial Sequence
  derived and/or modified sequence opt4 from hemagglutinin__InfluenzaA__ADG21161
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaaggagaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacaacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157261 - RNA, 1701 nt, Artificial Sequence
  derived and/or modified sequence opt4 from hemagglutinin__InfluenzaA__ADG21163
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacguguggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157262 - RNA, 1701 nt, Artificial Sequence
  derived and/or modified sequence opt4 from hemagglutinin__InfluenzaA__ADG21165
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcaucgccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucaagagauucgagaucuuccccaagaccaacagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157263 - RNA, 1701 nt, Artificial Sequence; identical to SEQ ID NO: 155176
  derived and/or modified sequence opt4 from hemagglutinin__InfluenzaA__ADG21166

SEQ ID NO: 157264 - RNA, 1701 nt, Artificial Sequence
  derived and/or modified sequence opt4 from hemagglutinin__InfluenzaA__ADG21168
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaaguucuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157265 - RNA, 1701 nt, Artificial Sequence; identical to SEQ ID NO: 157218
  derived and/or modified sequence opt4 from hemagglutinin__InfluenzaA__ADG21169

SEQ ID NO: 157266 - RNA, 1701 nt, Artificial Sequence; identical to SEQ ID NO: 155176
  derived and/or modified sequence opt4 from hemagglutinin__InfluenzaA__ADG21170

SEQ ID NO: 157267 - RNA, 1701 nt, Artificial Sequence; identical to SEQ ID NO: 155176
  derived and/or modified sequence opt4 from hemagglutinin__InfluenzaA__ADG21173

SEQ ID NO: 157268 - RNA, 1701 nt, Artificial Sequence; identical to SEQ ID NO: 155189
  derived and/or modified sequence opt4 from hemagglutinin__InfluenzaA__ADG21174

SEQ ID NO: 157269 - RNA, 1701 nt, Artificial Sequence; identical to SEQ ID NO: 155189
  derived and/or modified sequence opt4 from hemagglutinin__InfluenzaA__ADG21175

SEQ ID NO: 157270 - RNA, 1701 nt, Artificial Sequence; identical to SEQ ID NO: 155176
  derived and/or modified sequence opt4 from hemagglutinin__InfluenzaA__ADG21176

SEQ ID NO: 157271 - RNA, 1701 nt, Artificial Sequence; identical to SEQ ID NO: 155176
  derived and/or modified sequence opt4 from hemagglutinin__InfluenzaA__ADG21177

SEQ ID NO: 157272 - RNA, 1701 nt, Artificial Sequence; identical to SEQ ID NO: 155176
  derived and/or modified sequence opt4 from hemagglutinin__InfluenzaA__ADG21178

SEQ ID NO: 157273 - RNA, 1701 nt, Artificial Sequence; identical to SEQ ID NO: 155542
  derived and/or modified sequence opt4 from hemagglutinin__InfluenzaA__ADG21179

SEQ ID NO: 157274 - RNA, 1701 nt, Artificial Sequence; identical to SEQ ID NO: 155176
  derived and/or modified sequence opt4 from hemagglutinin__InfluenzaA__ADG21180

SEQ ID NO: 157275 - RNA, 1701 nt, Artificial Sequence; identical to SEQ ID NO: 155176
  derived and/or modified sequence opt4 from hemagglutinin__InfluenzaA__ADG21181

SEQ ID NO: 157276 - RNA, 1701 nt, Artificial Sequence; identical to SEQ ID NO: 155176
  derived and/or modified sequence opt4 from hemagglutinin__InfluenzaA__ADG21182

SEQ ID NO: 157277 - RNA, 1701 nt, Artificial Sequence; identical to SEQ ID NO: 155176
  derived and/or modified sequence opt4 from hemagglutinin__InfluenzaA__ADG21183

SEQ ID NO: 157278 - RNA, 1701 nt, Artificial Sequence; identical to SEQ ID NO: 156353
  derived and/or modified sequence opt4 from hemagglutinin__InfluenzaA__ADG21184

SEQ ID NO: 157279 - RNA, 1701 nt, Artificial Sequence
  derived and/or modified sequence opt4 from hemagglutinin__InfluenzaA__ADG21185
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccuggugaagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcagaugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157280 - RNA, 1701 nt, Artificial Sequence; identical to SEQ ID NO: 156535
  derived and/or modified sequence opt4 from hemagglutinin__InfluenzaA__ADG21188

SEQ ID NO: 157281 - RNA, 1707 nt, Artificial Sequence
  derived and/or modified sequence opt4 from hemagglutinin__InfluenzaA__ADG21402
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacugauccuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 157282 - RNA, 1704 nt, Artificial Sequence
  derived and/or modified sequence opt4 from hemagglutinin__InfluenzaA__ADG21414
auggagaagaucgugcugcugcuggccaucgugagcaucgugaagagcgaccagaucugcaucggcuaccacgccaacaacagcaccgagcacguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaagaacaacgccuaccccaccaucaagaagagcuacaacaacaccaaccaggaggaccugcuggugcuguggggcauccaccaccccaacgacggcgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 157283 - RNA, 1704 nt, Artificial Sequence
  derived and/or modified sequence opt4 from hemagglutinin__InfluenzaA__ADG21416
auggagaagaucgugcugcugcuggccaucgugagcaucgugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaagaacaacgccuaccccaccaucaagaagagcuacaacaacaccaaccaggaggaccugcuggugcuguggggcauccaccaccccaacgacgccgccgagcagaccggccuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgugaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 157284 - RNA, 1704 nt, Artificial Sequence
  derived and/or modified sequence opt4 from hemagglutinin__InfluenzaA__ADG21420
auggagaagaucgugcugcugcuggccaucgugagcaucgugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaagaacaacgccuaccccaccaucaagaagagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 157285 - RNA, 1704 nt, Artificial Sequence
  derived and/or modified sequence opt4 from hemagglutinin__InfluenzaA__ADG21422
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccaccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaagaacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagaagcaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 157286 - RNA, 1704 nt, Artificial Sequence
  derived and/or modified sequence opt4 from hemagglutinin__InfluenzaA__ADG21425
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacggcgccagcggcgugagcagcgccugccccuaccagggcagaagcagcuucuucagaaacgugguguggcugaccaagaagaacaacgccuaccccaccaucaagaagagcuacaacaacaccaaccaggaggaccugcuggugcuguggggcauccaccaccccaacgacgccgaggagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacgacaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccagggcgagaagagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacgcccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 157287 - RNA, 1704 nt, Artificial Sequence
  derived and/or modified sequence opt4 from hemagglutinin__InfluenzaA__ADG21429
auggagaagaucgugcugcugcuggccaucgugagcaucgugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcguggagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaagaacaacgccuaccccaccaucaagaagagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgugaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcgacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugcugcuguggaugugcagcaacggcagccugcagugcagaaucugcaucuga

SEQ ID NO: 157288 - RNA, 1704 nt, Artificial Sequence
  derived and/or modified sequence opt4 from hemagglutinin__InfluenzaA__ADG21437
auggagaagaucgugcugcugcuggccaucgugagcaucgugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugacccagaagaacaacgccuaccccaccaucaagaagagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgugaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 157289 - RNA, 1704 nt, Artificial Sequence
  derived and/or modified sequence opt4 from hemagglutinin__InfluenzaA__ADG21439
auggagaagaucgugcugcugcuggccaucgugagcaucgugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagggcagcuggagcgaccacgaggccagcggcgugagcagcgccugccccuaccagggcagaagcagcuucuucagaaacgugguguggcugaccaagaagaacaacgccuaccccaccaucaagaagagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugccccagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 157290 - RNA, 1704 nt, Artificial Sequence
  derived and/or modified sequence opt4 from hemagglutinin__InfluenzaA__ADG21441
auggagaagaucgugcugcugcuggccaucgugagcaucgugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccagcaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaagaacaacgccuaccccaccaucaagaagagcuacaacaacaccaaccaggaggaccugcuggugcuguggggcauccaccaccccaacgacgaggccgagcagaccagccuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 157291 - RNA, 1704 nt, Artificial Sequence
  derived and/or modified sequence opt4 from hemagglutinin__InfluenzaA__ADG21443
auggagaagaucgugcugcugcuggccaucgugagcaucgugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccaccaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaagaacaacgccuaccccaccaucaagaagagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 157292 - RNA, 1704 nt, Artificial Sequence
  derived and/or modified sequence opt4 from hemagglutinin__InfluenzaA__ADG21445
auggagaagaucgugcugcugcuggccaucgugagcaucgugaagagcgaccagaucugcaucggcuaccacgccaacaacagcaccgagcagguggacaccaucauggagaagaacgugaccgugacccacgcccaggacauccuggagaagacccacaacggcaagcugugcaaccuggacggcgugaagccccugauccugagagacugcagcguggccggcuggcugcugggcaaccccaugugcgacgaguuccugaacgugcccgaguggagcuacaucguggagaagaucaaccccagcaacgaccugugcuaccccggcaacuucaacgacuacgaggagcugaagcaccugcugagcagaaucaaccacuucgagaagauccagaucauccccaagaacagcuggagcgaccacgaggccagcggcgugagcagcgccugccccuaccagggcagaagcagcuucuucagaaacgugguguggcugaccaagaagaacaacgccuaccccaccaucaagaagagcuacaacaacaccaaccaggaggaccugcuggugcuguggggcauccaccaccccaacgacgaggccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagagcaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccuguuccuguggaugugcagcaacggcagccugcagugcagaaucugcaucuga

SEQ ID NO: 157293 - RNA, 1701 nt, Artificial Sequence; identical to SEQ ID NO: 155431
  derived and/or modified sequence opt4 from hemagglutinin__InfluenzaA__ADG21912

SEQ ID NO: 157294 - RNA, 1701 nt, Artificial Sequence; identical to SEQ ID NO: 155189
  derived and/or modified sequence opt4 from hemagglutinin__InfluenzaA__ADG21913

SEQ ID NO: 157295 - RNA, 1701 nt, Artificial Sequence
  derived and/or modified sequence opt4 from hemagglutinin__InfluenzaA__ADG21914
augaaggccaucaucguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157296 - RNA, 1701 nt, Artificial Sequence
  derived and/or modified sequence opt4 from hemagglutinin__InfluenzaA__ADG21915
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccaucgagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157297 - RNA, 1701 nt, Artificial Sequence; identical to SEQ ID NO: 155431
  derived and/or modified sequence opt4 from hemagglutinin__InfluenzaA__ADG21916

SEQ ID NO: 157298 - RNA, 1701 nt, Artificial Sequence; identical to SEQ ID NO: 155189
  derived and/or modified sequence opt4 from hemagglutinin__InfluenzaA__ADG21917

SEQ ID NO: 157299 - RNA, 1701 nt, Artificial Sequence; identical to SEQ ID NO: 156689
  derived and/or modified sequence opt4 from hemagglutinin__InfluenzaA__ADG21918

SEQ ID NO: 157300 - RNA, 1701 nt, Artificial Sequence
  derived and/or modified sequence opt4 from hemagglutinin__InfluenzaA__ADG21919
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugaccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157301 - RNA, 1701 nt, Artificial Sequence; identical to SEQ ID NO: 155431
  derived and/or modified sequence opt4 from hemagglutinin__InfluenzaA__ADG21921

SEQ ID NO: 157302 - RNA, 1701 nt, Artificial Sequence; identical to SEQ ID NO: 155189
  derived and/or modified sequence opt4 from hemagglutinin__InfluenzaA__ADG21922

SEQ ID NO: 157303 - RNA, 1701 nt, Artificial Sequence
  derived and/or modified sequence opt4 from hemagglutinin__InfluenzaA__ADG21923
augaaggccauccugguggugcugcuguacaccuucgccaccgccaacgccgacacccugugcaucggcuaccacgccaacaacagcaccgacaccguggacaccgugcuggagaagaacgugaccgugacccacagcgccaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157304 - RNA, 1701 nt, Artificial Sequence
  derived and/or modified sequence opt4 from hemagglutinin__InfluenzaA__ADG21924
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggagaacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157305 - RNA, 1701 nt, Artificial Sequence
  derived and/or modified sequence opt4 from hemagglutinin__InfluenzaA__ADG21925
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157306 - RNA, 1701 nt, Artificial Sequence
  derived and/or modified sequence opt4 from hemagglutinin__InfluenzaA__ADG21926
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaaaccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157307 - RNA, 1701 nt, Artificial Sequence; identical to SEQ ID NO: 155431
  derived and/or modified sequence opt4 from hemagglutinin__InfluenzaA__ADG21927

SEQ ID NO: 157308 - RNA, 1701 nt, Artificial Sequence
  derived and/or modified sequence opt4 from hemagglutinin__InfluenzaA__ADG21928
augaaggccacccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccagagugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157309 - RNA, 1701 nt, Artificial Sequence; identical to SEQ ID NO: 157305
  derived and/or modified sequence opt4 from hemagglutinin__InfluenzaA__ADG21930

SEQ ID NO: 157310 - RNA, 1701 nt, Artificial Sequence; identical to SEQ ID NO: 155431
  derived and/or modified sequence opt4 from hemagglutinin__InfluenzaA__ADG21931

SEQ ID NO: 157311 - RNA, 1701 nt, Artificial Sequence; identical to SEQ ID NO: 155431
  derived and/or modified sequence opt4 from hemagglutinin__InfluenzaA__ADG21932

SEQ ID NO: 157312 - RNA, 1701 nt, Artificial Sequence; identical to SEQ ID NO: 155431
  derived and/or modified sequence opt4 from hemagglutinin__InfluenzaA__ADG21933

SEQ ID NO: 157313 - RNA, 1701 nt, Artificial Sequence; identical to SEQ ID NO: 157305
  derived and/or modified sequence opt4 from hemagglutinin__InfluenzaA__ADG21934

SEQ ID NO: 157314 - RNA, 1701 nt, Artificial Sequence
  derived and/or modified sequence opt4 from hemagglutinin__InfluenzaA__ADG21935
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaacugccagacccccaacggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157315 - RNA, 1701 nt, Artificial Sequence; identical to SEQ ID NO: 155431
  derived and/or modified sequence opt4 from hemagglutinin__InfluenzaA__ADG21936

SEQ ID NO: 157316 - RNA, 1701 nt, Artificial Sequence; identical to SEQ ID NO: 155431
  derived and/or modified sequence opt4 from hemagglutinin__InfluenzaA__ADG21937

SEQ ID NO: 157317 - RNA, 1701 nt, Artificial Sequence
  derived and/or modified sequence opt4 from hemagglutinin__InfluenzaA__ADG21938
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaaaccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157318 - RNA, 1701 nt, Artificial Sequence; identical to SEQ ID NO: 155431
  derived and/or modified sequence opt4 from hemagglutinin__InfluenzaA__ADG21939

SEQ ID NO: 157319 - RNA, 1701 nt, Artificial Sequence; identical to SEQ ID NO: 155431
  derived and/or modified sequence opt4 from hemagglutinin__InfluenzaA__ADG21940

SEQ ID NO: 157320 - RNA, 1701 nt, Artificial Sequence
  derived and/or modified sequence opt4 from hemagglutinin__InfluenzaA__ADG21941
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157321 - RNA, 1701 nt, Artificial Sequence
  derived and/or modified sequence opt4 from hemagglutinin__InfluenzaA__ADG21943
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccaacagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157322 - RNA, 1701 nt, Artificial Sequence
  derived and/or modified sequence opt4 from hemagglutinin__InfluenzaA__ADG21944
auggaggccauccugaucgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157323 - RNA, 1701 nt, Artificial Sequence; identical to SEQ ID NO: 155431
  derived and/or modified sequence opt4 from hemagglutinin__InfluenzaA__ADG21945

SEQ ID NO: 157324 - RNA, 1701 nt, Artificial Sequence; identical to SEQ ID NO: 155431
  derived and/or modified sequence opt4 from hemagglutinin__InfluenzaA__ADG21946

SEQ ID NO: 157325 - RNA, 1701 nt, Artificial Sequence; identical to SEQ ID NO: 155431
  derived and/or modified sequence opt4 from hemagglutinin__InfluenzaA__ADG21947

SEQ ID NO: 157326 - RNA, 1701 nt, Artificial Sequence
  derived and/or modified sequence opt4 from hemagglutinin__InfluenzaA__ADG21948
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggaccaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157327 - RNA, 1701 nt, Artificial Sequence
  derived and/or modified sequence opt4 from hemagglutinin__InfluenzaA__ADG27794
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaccuaccagauccuggccaucuacagcaccguggccagcagccuggugcugguggugagccugggcgccaucagcuucuggaugugcagcaacggcagccugcagugcagaaucugcaucuga

SEQ ID NO: 157328 - RNA, 1701 nt, Artificial Sequence; identical to SEQ ID NO: 155176
  derived and/or modified sequence opt4 from hemagglutinin__InfluenzaA__ADG27948

SEQ ID NO: 157329 - RNA, 1701 nt, Artificial Sequence; identical to SEQ ID NO: 155176
  derived and/or modified sequence opt4 from hemagglutinin__InfluenzaA__ADG27966

SEQ ID NO: 157330 - RNA, 1701 nt, Artificial Sequence
  derived and/or modified sequence opt4 from hemagglutinin__InfluenzaA__ADG27974
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccugauccugguggugagccugggcgccaucagcuucuggaugugcagcaacggcagccugcagugcagaaucugcaucuga

SEQ ID NO: 157331 - RNA, 1701 nt, Artificial Sequence
  derived and/or modified sequence opt4 from hemagglutinin__InfluenzaA__ADG27982
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaagcuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157332 - RNA, 1701 nt, Artificial Sequence; identical to SEQ ID NO: 155176
  derived and/or modified sequence opt4 from hemagglutinin__InfluenzaA__ADG27988

SEQ ID NO: 157333 - RNA, 1701 nt, Artificial Sequence; identical to SEQ ID NO: 155176
  derived and/or modified sequence opt4 from hemagglutinin__InfluenzaA__ADG27997

SEQ ID NO: 157334 - RNA, 1701 nt, Artificial Sequence; identical to SEQ ID NO: 155176
  derived and/or modified sequence opt4 from hemagglutinin__InfluenzaA__ADG28011

SEQ ID NO: 157335 - RNA, 1701 nt, Artificial Sequence; identical to SEQ ID NO: 156741
  derived and/or modified sequence opt4 from hemagglutinin__InfluenzaA__ADG42093

SEQ ID NO: 157336 - RNA, 1701 nt, Artificial Sequence; identical to SEQ ID NO: 156353
  derived and/or modified sequence opt4 from hemagglutinin__InfluenzaA__ADG42103

SEQ ID NO: 157337 - RNA, 1701 nt, Artificial Sequence; identical to SEQ ID NO: 155542
  derived and/or modified sequence opt4 from hemagglutinin__InfluenzaA__ADG42113

SEQ ID NO: 157338 - RNA, 1701 nt, Artificial Sequence; identical to SEQ ID NO: 156741
  derived and/or modified sequence opt4 from hemagglutinin__InfluenzaA__ADG42123

SEQ ID NO: 157339 - RNA, 1701 nt, Artificial Sequence
  derived and/or modified sequence opt4 from hemagglutinin__InfluenzaA__ADG42133
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugccccuacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggugaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157340 - RNA, 1701 nt, Artificial Sequence
  derived and/or modified sequence opt4 from hemagglutinin__InfluenzaA__ADG42143
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagaagaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 157341 - RNA, 1701 nt, Artificial Sequence
  derived and/or modified sequence opt4 from hemagglutinin__InfluenzaA__ADG42153
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcaucaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcuggacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157342 - RNA, 1701 nt, Artificial Sequence; identical to SEQ ID NO: 155189
  derived and/or modified sequence opt4 from hemagglutinin__InfluenzaA__ADG42193

SEQ ID NO: 157343 - RNA, 1701 nt, Artificial Sequence; identical to SEQ ID NO: 155189
  derived and/or modified sequence opt4 from hemagglutinin__InfluenzaA__ADG42213

SEQ ID NO: 157344 - RNA, 1701 nt, Artificial Sequence; identical to SEQ ID NO: 155189
  derived and/or modified sequence opt4 from hemagglutinin__InfluenzaA__ADG42233

SEQ ID NO: 157345 - RNA, 1701 nt, Artificial Sequence
  derived and/or modified sequence opt4 from hemagglutinin__InfluenzaA__ADG42243
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcuggacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157346 - RNA, 1701 nt, Artificial Sequence; identical to SEQ ID NO: 156609
  derived and/or modified sequence opt4 from hemagglutinin__InfluenzaA__ADG42253

SEQ ID NO: 157347 - RNA, 1701 nt, Artificial Sequence; identical to SEQ ID NO: 155189
  derived and/or modified sequence opt4 from hemagglutinin__InfluenzaA__ADG42263

SEQ ID NO: 157348 - RNA, 1701 nt, Artificial Sequence; identical to SEQ ID NO: 156290
  derived and/or modified sequence opt4 from hemagglutinin__InfluenzaA__ADG42273

SEQ ID NO: 157349 - RNA, 1701 nt, Artificial Sequence; identical to SEQ ID NO: 156290
  derived and/or modified sequence opt4 from hemagglutinin__InfluenzaA__ADG42283

SEQ ID NO: 157350 - RNA, 1701 nt, Artificial Sequence; identical to SEQ ID NO: 156872
  derived and/or modified sequence opt4 from hemagglutinin__InfluenzaA__ADG42293

SEQ ID NO: 157351 - RNA, 1701 nt, Artificial Sequence
  derived and/or modified sequence opt4 from hemagglutinin__InfluenzaA__ADG42303
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugaagggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucgugaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157352 - RNA, 1701 nt, Artificial Sequence; identical to SEQ ID NO: 156899
  derived and/or modified sequence opt4 from hemagglutinin__InfluenzaA__ADG42313

SEQ ID NO: 157353 - RNA, 1701 nt, Artificial Sequence
  derived and/or modified sequence opt4 from hemagglutinin__InfluenzaA__ADG42323
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157354 - RNA, 1701 nt, Artificial Sequence
  derived and/or modified sequence opt4 from hemagglutinin__InfluenzaA__ADG42333
augaaggccauccugguggugcugcuguacacccuggccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcaucgccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacgcccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157355 - RNA, 1701 nt, Artificial Sequence
  derived and/or modified sequence opt4 from hemagglutinin__InfluenzaA__ADG42343
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagcaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157356 - RNA, 1701 nt, Artificial Sequence
  derived and/or modified sequence opt4 from hemagglutinin__InfluenzaA__ADG42363
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcaucgccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157357 - RNA, 1701 nt, Artificial Sequence
  derived and/or modified sequence opt4 from hemagglutinin__InfluenzaA__ADG42373
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157358 - RNA, 1701 nt, Artificial Sequence
  derived and/or modified sequence opt4 from hemagglutinin__InfluenzaA__ADG42393
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacgagaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugcuggugagccugggcgccaucagcuucuggaugugcagcaacggcagccugcagugcagaaucugcaucuga

SEQ ID NO: 157359 - RNA, 1701 nt, Artificial Sequence; identical to SEQ ID NO: 156353
  derived and/or modified sequence opt4 from hemagglutinin__InfluenzaA__ADG42403

SEQ ID NO: 157360 - RNA, 1701 nt, Artificial Sequence; identical to SEQ ID NO: 156609
  derived and/or modified sequence opt4 from hemagglutinin__InfluenzaA__ADG42413

SEQ ID NO: 157361 - RNA, 1701 nt, Artificial Sequence; identical to SEQ ID NO: 157356
  derived and/or modified sequence opt4 from hemagglutinin__InfluenzaA__ADG42423

SEQ ID NO: 157362 - RNA, 1701 nt, Artificial Sequence; identical to SEQ ID NO: 156609
  derived and/or modified sequence opt4 from hemagglutinin__InfluenzaA__ADG42443

SEQ ID NO: 157363 - RNA, 1701 nt, Artificial Sequence
  derived and/or modified sequence opt4 from hemagglutinin__InfluenzaA__ADG42453
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaguggagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157364 - RNA, 1701 nt, Artificial Sequence; identical to SEQ ID NO: 155542
  derived and/or modified sequence opt4 from hemagglutinin__InfluenzaA__ADG42463

SEQ ID NO: 157365 - RNA, 1701 nt, Artificial Sequence; identical to SEQ ID NO: 155189
  derived and/or modified sequence opt4 from hemagglutinin__InfluenzaA__ADG42473

SEQ ID NO: 157366 - RNA, 1701 nt, Artificial Sequence; identical to SEQ ID NO: 156609
  derived and/or modified sequence opt4 from hemagglutinin__InfluenzaA__ADG42483

SEQ ID NO: 157367 - RNA, 1701 nt, Artificial Sequence; identical to SEQ ID NO: 156741
  derived and/or modified sequence opt4 from hemagglutinin__InfluenzaA__ADG42493

SEQ ID NO: 157368 - RNA, 1701 nt, Artificial Sequence; identical to SEQ ID NO: 156802
  derived and/or modified sequence opt4 from hemagglutinin__InfluenzaA__ADG42503

SEQ ID NO: 157369 - RNA, 1701 nt, Artificial Sequence; identical to SEQ ID NO: 156290
  derived and/or modified sequence opt4 from hemagglutinin__InfluenzaA__ADG42513

SEQ ID NO: 157370 - RNA, 1701 nt, Artificial Sequence
  derived and/or modified sequence opt4 from hemagglutinin__InfluenzaA__ADG42533
augaaggccauccugguggugcugcuguacaccuucgccaccgccaaggccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157371 - RNA, 1701 nt, Artificial Sequence
  derived and/or modified sequence opt4 from hemagglutinin__InfluenzaA__ADG42553
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcagccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157372 - RNA, 1701 nt, Artificial Sequence
  derived and/or modified sequence opt4 from hemagglutinin__InfluenzaA__ADG42573
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugaucgagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaagcuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157373 - RNA, 1701 nt, Artificial Sequence
  derived and/or modified sequence opt4 from hemagglutinin__InfluenzaA__ADG42583
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacagcuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157374 - RNA, 1701 nt, Artificial Sequence; identical to SEQ ID NO: 156786
  derived and/or modified sequence opt4 from hemagglutinin__InfluenzaA__ADG42593

SEQ ID NO: 157375 - RNA, 1701 nt, Artificial Sequence
  derived and/or modified sequence opt4 from hemagglutinin__InfluenzaA__ADG42603
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagaaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaccagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcagcaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157376 - RNA, 1701 nt, Artificial Sequence
  derived and/or modified sequence opt4 from hemagglutinin__InfluenzaA__ADG42613
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157377 - RNA, 1701 nt, Artificial Sequence; identical to SEQ ID NO: 156816
  derived and/or modified sequence opt4 from hemagglutinin__InfluenzaA__ADG42623

SEQ ID NO: 157378 - RNA, 1701 nt, Artificial Sequence; identical to SEQ ID NO: 155189
  derived and/or modified sequence opt4 from hemagglutinin__InfluenzaA__ADG42633

SEQ ID NO: 157379 - RNA, 1701 nt, Artificial Sequence
  derived and/or modified sequence opt4 from hemagglutinin__InfluenzaA__ADG42643
augaaggccauccugguggugcugcuguacaccuucgccaccgccaacgccgacacccugugcaucggcuaccacgccaacaacagcaccgacaccguggacaccgugcuggagaagaacgugaccgugacccacagcgccaaccugcuggaggacaagcacaacggcaagcugugcaagcugagaggcgccgccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacgugaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157380 - RNA, 1701 nt, Artificial Sequence
  derived and/or modified sequence opt4 from hemagglutinin__InfluenzaA__ADG42653
augaaggccauccugguggugcugcuguacaccagcgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157381 - RNA, 1701 nt, Artificial Sequence; identical to SEQ ID NO: 156353
  derived and/or modified sequence opt4 from hemagglutinin__InfluenzaA__ADG42663

SEQ ID NO: 157382 - RNA, 1701 nt, Artificial Sequence
  derived and/or modified sequence opt4 from hemagglutinin__InfluenzaA__ADG42673
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugaagggcguggccccccugcaccugggcaagugcaacaucgccggcuggauccugggcaaccccgagugcgagagccugagcaccgccggcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157383 - RNA, 1701 nt, Artificial Sequence
  derived and/or modified sequence opt4 from hemagglutinin__InfluenzaA__ADG42683
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcaacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157384 - RNA, 1701 nt, Artificial Sequence; identical to SEQ ID NO: 156353
  derived and/or modified sequence opt4 from hemagglutinin__InfluenzaA__ADG42693

SEQ ID NO: 157385 - RNA, 1701 nt, Artificial Sequence; identical to SEQ ID NO: 157061
  derived and/or modified sequence opt4 from hemagglutinin__InfluenzaA__ADG42703

SEQ ID NO: 157386 - RNA, 1701 nt, Artificial Sequence
  derived and/or modified sequence opt4 from hemagglutinin__InfluenzaA__ADG42723
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagauggccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157387 - RNA, 1701 nt, Artificial Sequence; identical to SEQ ID NO: 156816
  derived and/or modified sequence opt4 from hemagglutinin__InfluenzaA__ADG42743

SEQ ID NO: 157388 - RNA, 1701 nt, Artificial Sequence
  derived and/or modified sequence opt4 from hemagglutinin__InfluenzaA__ADG42753
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacagcggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157389 - RNA, 1701 nt, Artificial Sequence; identical to SEQ ID NO: 156353
  derived and/or modified sequence opt4 from hemagglutinin__InfluenzaA__ADG42763

SEQ ID NO: 157390 - RNA, 1701 nt, Artificial Sequence; identical to SEQ ID NO: 156353
  derived and/or modified sequence opt4 from hemagglutinin__InfluenzaA__ADG42773

SEQ ID NO: 157391 - RNA, 1701 nt, Artificial Sequence
  derived and/or modified sequence opt4 from hemagglutinin__InfluenzaA__ADG42783
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157392 - RNA, 1701 nt, Artificial Sequence; identical to SEQ ID NO: 156353
  derived and/or modified sequence opt4 from hemagglutinin__InfluenzaA__ADG42793

SEQ ID NO: 157393 - RNA, 1701 nt, Artificial Sequence; identical to SEQ ID NO: 157391
  derived and/or modified sequence opt4 from hemagglutinin__InfluenzaA__ADG42803

SEQ ID NO: 157394 - RNA, 1701 nt, Artificial Sequence; identical to SEQ ID NO: 156741
  derived and/or modified sequence opt4 from hemagglutinin__InfluenzaA__ADG42813

SEQ ID NO: 157395 - RNA, 1701 nt, Artificial Sequence; identical to SEQ ID NO: 156884
  derived and/or modified sequence opt4 from hemagglutinin__InfluenzaA__ADG42823

SEQ ID NO: 157396 - RNA, 1701 nt, Artificial Sequence; identical to SEQ ID NO: 156786
  derived and/or modified sequence opt4 from hemagglutinin__InfluenzaA__ADG42833

SEQ ID NO: 157397 - RNA, 1701 nt, Artificial Sequence; identical to SEQ ID NO: 156353
  derived and/or modified sequence opt4 from hemagglutinin__InfluenzaA__ADG42843

SEQ ID NO: 157398 - RNA, 1701 nt, Artificial Sequence; identical to SEQ ID NO: 156353
  derived and/or modified sequence opt4 from hemagglutinin__InfluenzaA__ADG42853

SEQ ID NO: 157399 - RNA, 1701 nt, Artificial Sequence; identical to SEQ ID NO: 156907
  derived and/or modified sequence opt4 from hemagglutinin__InfluenzaA__ADG42863

SEQ ID NO: 157400 - RNA, 1701 nt, Artificial Sequence; identical to SEQ ID NO: 156927
  derived and/or modified sequence opt4 from hemagglutinin__InfluenzaA__ADG42883

SEQ ID NO: 157401 - RNA, 1701 nt, Artificial Sequence
  derived and/or modified sequence opt4 from hemagglutinin__InfluenzaA__ADG42893
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaaccugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157402 - RNA, 1701 nt, Artificial Sequence; identical to SEQ ID NO: 155189
  derived and/or modified sequence opt4 from hemagglutinin__InfluenzaA__ADG42903

SEQ ID NO: 157403 - RNA, 1701 nt, Artificial Sequence; identical to SEQ ID NO: 156353
  derived and/or modified sequence opt4 from hemagglutinin__InfluenzaA__ADG42913

SEQ ID NO: 157404 - RNA, 1701 nt, Artificial Sequence; identical to SEQ ID NO: 156917
  derived and/or modified sequence opt4 from hemagglutinin__InfluenzaA__ADG42923

SEQ ID NO: 157405 - RNA, 1701 nt, Artificial Sequence
  derived and/or modified sequence opt4 from hemagglutinin__InfluenzaA__ADG57087
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccaucagccuggugcugguggugagccugggcgccaucagcuucuggaugugcagcaacggcagccugagaugcagaaucugcaucuga

SEQ ID NO: 157406 - RNA, 1701 nt, Artificial Sequence; identical to SEQ ID NO: 155189
  derived and/or modified sequence opt4 from hemagglutinin__InfluenzaA__ADG57088

SEQ ID NO: 157407 - RNA, 1701 nt, Artificial Sequence
  derived and/or modified sequence opt4 from hemagglutinin__InfluenzaA__ADG57089
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucauccaguacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccgaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157408 - RNA, 1701 nt, Artificial Sequence
  derived and/or modified sequence opt4 from hemagglutinin__InfluenzaA__ADG57090
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagcaucuaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgcccagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157409 - RNA, 1701 nt, Artificial Sequence
  derived and/or modified sequence opt4 from hemagglutinin__InfluenzaA__ADG57091
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagagaggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157410 - RNA, 1701 nt, Artificial Sequence
  derived and/or modified sequence opt4 from hemagglutinin__InfluenzaA__ADG57092
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaucaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157411 - RNA, 1701 nt, Artificial Sequence
  derived and/or modified sequence opt4 from hemagglutinin__InfluenzaA__ADG57093
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggagauccuggugcuguggggcauccaccaccccagcaccagcgccgaccagcagagccuguaccagaacgccgacgccuacguguucguguggagcagcagauacagcaagaaguucaagcccgagaucgccaucagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157412 - RNA, 1701 nt, Artificial Sequence
  derived and/or modified sequence opt4 from hemagglutinin__InfluenzaA__ADG57094
augaaggccauccugguggugcugcuguacaccuucgccaccgccaacgccgacacccugugcgugggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157413 - RNA, 1701 nt, Artificial Sequence; identical to SEQ ID NO: 155189
  derived and/or modified sequence opt4 from hemagglutinin__InfluenzaA__ADG57095

SEQ ID NO: 157414 - RNA, 1701 nt, Artificial Sequence
  derived and/or modified sequence opt4 from hemagglutinin__InfluenzaA__ADG57097
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157415 - RNA, 1701 nt, Artificial Sequence; identical to SEQ ID NO: 156353
  derived and/or modified sequence opt4 from hemagglutinin__InfluenzaA__ADG57098

SEQ ID NO: 157416 - RNA, 1701 nt, Artificial Sequence
  derived and/or modified sequence opt4 from hemagglutinin__InfluenzaA__ADG57099
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuaccacuggacccugguggagcccggcgacaagaucaccuucgaggccaccggcaaccugguggugcccagauacgccuucgccauggagagaaacgccggcagcggcaucaucaucaccgacacccccgugcacgacugcaacaccaccugccagacccccaagggcgccgugaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157417 - RNA, 1701 nt, Artificial Sequence
  derived and/or modified sequence opt4 from hemagglutinin__InfluenzaA__ADG57100
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccggcggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157418 - RNA, 1701 nt, Artificial Sequence; identical to SEQ ID NO: 155189
  derived and/or modified sequence opt4 from hemagglutinin__InfluenzaA__ADG58939

SEQ ID NO: 157419 - RNA, 1701 nt, Artificial Sequence; identical to SEQ ID NO: 155189
  derived and/or modified sequence opt4 from hemagglutinin__InfluenzaA__ADG58940

SEQ ID NO: 157420 - RNA, 1701 nt, Artificial Sequence
  derived and/or modified sequence opt4 from hemagglutinin__InfluenzaA__ADG58941
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccacgagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157421 - RNA, 1701 nt, Artificial Sequence
  derived and/or modified sequence opt4 from hemagglutinin__InfluenzaA__ADG58942
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccugcaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157422 - RNA, 1701 nt, Artificial Sequence; identical to SEQ ID NO: 155189
  derived and/or modified sequence opt4 from hemagglutinin__InfluenzaA__ADG58943

SEQ ID NO: 157423 - RNA, 1701 nt, Artificial Sequence
  derived and/or modified sequence opt4 from hemagglutinin__InfluenzaA__ADG58944
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157424 - RNA, 1701 nt, Artificial Sequence; identical to SEQ ID NO: 155987
  derived and/or modified sequence opt4 from hemagglutinin__InfluenzaA__ADG58946

SEQ ID NO: 157425 - RNA, 1701 nt, Artificial Sequence; identical to SEQ ID NO: 155189
  derived and/or modified sequence opt4 from hemagglutinin__InfluenzaA__ADG58947

SEQ ID NO: 157426 - RNA, 1701 nt, Artificial Sequence
  derived and/or modified sequence opt4 from hemagglutinin__InfluenzaA__ADG58948
augaaggccauccugaucgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157427 - RNA, 1701 nt, Artificial Sequence
  derived and/or modified sequence opt4 from hemagglutinin__InfluenzaA__ADG58949
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacaccagcgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157428 - RNA, 1701 nt, Artificial Sequence
  derived and/or modified sequence opt4 from hemagglutinin__InfluenzaA__ADG58951
augaaggccauccugguggugcugcugcacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcggcaacggcaccugcuaccccggcgaguucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcaucgagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157429 - RNA, 1701 nt, Artificial Sequence; identical to SEQ ID NO: 157428
  derived and/or modified sequence opt4 from hemagglutinin__InfluenzaA__ADG58952

SEQ ID NO: 157430 - RNA, 1701 nt, Artificial Sequence; identical to SEQ ID NO: 157428
  derived and/or modified sequence opt4 from hemagglutinin__InfluenzaA__ADG58953

SEQ ID NO: 157431 - RNA, 1701 nt, Artificial Sequence; identical to SEQ ID NO: 157428
  derived and/or modified sequence opt4 from hemagglutinin__InfluenzaA__ADG58954

SEQ ID NO: 157432 - RNA, 1701 nt, Artificial Sequence; identical to SEQ ID NO: 157428
  derived and/or modified sequence opt4 from hemagglutinin__InfluenzaA__ADG58955

SEQ ID NO: 157433 - RNA, 1701 nt, Artificial Sequence; identical to SEQ ID NO: 157428
  derived and/or modified sequence opt4 from hemagglutinin__InfluenzaA__ADG58956

SEQ ID NO: 157434 - RNA, 1701 nt, Artificial Sequence
  derived and/or modified sequence opt4 from hemagglutinin__InfluenzaA__ADG58957
augaaggccauccugguggugcugcugcacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaacagcggcaacggcaccugcuaccccggcgaguucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157435 - RNA, 1701 nt, Artificial Sequence
  derived and/or modified sequence opt4 from hemagglutinin__InfluenzaA__ADG58959
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccaacagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157436 - RNA, 1701 nt, Artificial Sequence; identical to SEQ ID NO: 157353
  derived and/or modified sequence opt4 from hemagglutinin__InfluenzaA__ADG58960

SEQ ID NO: 157437 - RNA, 1701 nt, Artificial Sequence; identical to SEQ ID NO: 157353
  derived and/or modified sequence opt4 from hemagglutinin__InfluenzaA__ADG58961

SEQ ID NO: 157438 - RNA, 1701 nt, Artificial Sequence; identical to SEQ ID NO: 157353
  derived and/or modified sequence opt4 from hemagglutinin__InfluenzaA__ADG58962

SEQ ID NO: 157439 - RNA, 1701 nt, Artificial Sequence; identical to SEQ ID NO: 157353
  derived and/or modified sequence opt4 from hemagglutinin__InfluenzaA__ADG58963

SEQ ID NO: 157440 - RNA, 1701 nt, Artificial Sequence; identical to SEQ ID NO: 157353
  derived and/or modified sequence opt4 from hemagglutinin__InfluenzaA__ADG58964

SEQ ID NO: 157441 - RNA, 1701 nt, Artificial Sequence; identical to SEQ ID NO: 157353
  derived and/or modified sequence opt4 from hemagglutinin__InfluenzaA__ADG58965

SEQ ID NO: 157442 - RNA, 1701 nt, Artificial Sequence; identical to SEQ ID NO: 157353
  derived and/or modified sequence opt4 from hemagglutinin__InfluenzaA__ADG58966

SEQ ID NO: 157443 - RNA, 1701 nt, Artificial Sequence; identical to SEQ ID NO: 157353
  derived and/or modified sequence opt4 from hemagglutinin__InfluenzaA__ADG58967

SEQ ID NO: 157444 - RNA, 1701 nt, Artificial Sequence; identical to SEQ ID NO: 157353
  derived and/or modified sequence opt4 from hemagglutinin__InfluenzaA__ADG58968

SEQ ID NO: 157445 - RNA, 1701 nt, Artificial Sequence; identical to SEQ ID NO: 155189
  derived and/or modified sequence opt4 from hemagglutinin__InfluenzaA__ADG59628

SEQ ID NO: 157446 - RNA, 1701 nt, Artificial Sequence; identical to SEQ ID NO: 155189
  derived and/or modified sequence opt4 from hemagglutinin__InfluenzaA__ADG59629

SEQ ID NO: 157447 - RNA, 1701 nt, Artificial Sequence; identical to SEQ ID NO: 155189
  derived and/or modified sequence opt4 from hemagglutinin__InfluenzaA__ADG59630

SEQ ID NO: 157448 - RNA, 1701 nt, Artificial Sequence; identical to SEQ ID NO: 155189
  derived and/or modified sequence opt4 from hemagglutinin__InfluenzaA__ADG59631

SEQ ID NO: 157449 - RNA, 1701 nt, Artificial Sequence; identical to SEQ ID NO: 155189
  derived and/or modified sequence opt4 from hemagglutinin__InfluenzaA__ADG59632

SEQ ID NO: 157450 - RNA, 1701 nt, Artificial Sequence; identical to SEQ ID NO: 156290
  derived and/or modified sequence opt4 from hemagglutinin__InfluenzaA__ADG59633

SEQ ID NO: 157451 - RNA, 1701 nt, Artificial Sequence; identical to SEQ ID NO: 156290
  derived and/or modified sequence opt4 from hemagglutinin__InfluenzaA__ADG59634

SEQ ID NO: 157452 - RNA, 1701 nt, Artificial Sequence; identical to SEQ ID NO: 155189
  derived and/or modified sequence opt4 from hemagglutinin__InfluenzaA__ADG59635

SEQ ID NO: 157453 - RNA, 1701 nt, Artificial Sequence
  derived and/or modified sequence opt4 from hemagglutinin__InfluenzaA__ADG59636
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157454 - RNA, 1701 nt, Artificial Sequence; identical to SEQ ID NO: 155937
  derived and/or modified sequence opt4 from hemagglutinin__InfluenzaA__ADG59638

SEQ ID NO: 157455 - RNA, 1701 nt, Artificial Sequence; identical to SEQ ID NO: 156290
  derived and/or modified sequence opt4 from hemagglutinin__InfluenzaA__ADG59639

SEQ ID NO: 157456 - RNA, 1701 nt, Artificial Sequence; identical to SEQ ID NO: 155542
  derived and/or modified sequence opt4 from hemagglutinin__InfluenzaA__ADG59641

SEQ ID NO: 157457 - RNA, 1701 nt, Artificial Sequence; identical to SEQ ID NO: 156032
  derived and/or modified sequence opt4 from hemagglutinin__InfluenzaA__ADG59643

SEQ ID NO: 157458 - RNA, 1701 nt, Artificial Sequence; identical to SEQ ID NO: 155176
  derived and/or modified sequence opt4 from hemagglutinin__InfluenzaA__ADG59644

SEQ ID NO: 157459 - RNA, 1701 nt, Artificial Sequence; identical to SEQ ID NO: 155189
  derived and/or modified sequence opt4 from hemagglutinin__InfluenzaA__ADG59646

SEQ ID NO: 157460 - RNA, 1701 nt, Artificial Sequence; identical to SEQ ID NO: 156290
  derived and/or modified sequence opt4 from hemagglutinin__InfluenzaA__ADG59647

SEQ ID NO: 157461 - RNA, 1701 nt, Artificial Sequence; identical to SEQ ID NO: 156353
  derived and/or modified sequence opt4 from hemagglutinin__InfluenzaA__ADG59648

SEQ ID NO: 157462 - RNA, 1701 nt, Artificial Sequence; identical to SEQ ID NO: 156353
  derived and/or modified sequence opt4 from hemagglutinin__InfluenzaA__ADG59649

SEQ ID NO: 157463 - RNA, 1701 nt, Artificial Sequence; identical to SEQ ID NO: 156353
  derived and/or modified sequence opt4 from hemagglutinin__InfluenzaA__ADG59650

SEQ ID NO: 157464 - RNA, 1701 nt, Artificial Sequence; identical to SEQ ID NO: 156353
  derived and/or modified sequence opt4 from hemagglutinin__InfluenzaA__ADG59651

SEQ ID NO: 157465 - RNA, 1701 nt, Artificial Sequence; identical to SEQ ID NO: 155189
  derived and/or modified sequence opt4 from hemagglutinin__InfluenzaA__ADG59652

SEQ ID NO: 157466 - RNA, 1701 nt, Artificial Sequence; identical to SEQ ID NO: 155189
  derived and/or modified sequence opt4 from hemagglutinin__InfluenzaA__ADG59653

SEQ ID NO: 157467 - RNA, 1701 nt, Artificial Sequence; identical to SEQ ID NO: 157453
  derived and/or modified sequence opt4 from hemagglutinin__InfluenzaA__ADG59655

SEQ ID NO: 157468 - RNA, 1701 nt, Artificial Sequence; identical to SEQ ID NO: 156290
  derived and/or modified sequence opt4 from hemagglutinin__InfluenzaA__ADG59656

SEQ ID NO: 157469 - RNA, 1701 nt, Artificial Sequence
  derived and/or modified sequence opt4 from hemagglutinin__InfluenzaA__ADG59657
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcacccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157470 - RNA, 1701 nt, Artificial Sequence
  derived and/or modified sequence opt4 from hemagglutinin__InfluenzaA__ADG59658
augaaggccauccugguggugcugcuguacaccuucgccaccgccaacgccgacacccugugcaucggcuaccacgccaacaacagcaccgacaccaucgacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaaaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157471 - RNA, 1701 nt, Artificial Sequence; identical to SEQ ID NO: 155636
  derived and/or modified sequence opt4 from hemagglutinin__InfluenzaA__ADG59659

SEQ ID NO: 157472 - RNA, 1701 nt, Artificial Sequence; identical to SEQ ID NO: 155636
  derived and/or modified sequence opt4 from hemagglutinin__InfluenzaA__ADG59660

SEQ ID NO: 157473 - RNA, 1701 nt, Artificial Sequence; identical to SEQ ID NO: 155542
  derived and/or modified sequence opt4 from hemagglutinin__InfluenzaA__ADG59662

SEQ ID NO: 157474 - RNA, 1701 nt, Artificial Sequence
  derived and/or modified sequence opt4 from hemagglutinin__InfluenzaA__ADG59663
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccuuccacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157475 - RNA, 1701 nt, Artificial Sequence; identical to SEQ ID NO: 155542
  derived and/or modified sequence opt4 from hemagglutinin__InfluenzaA__ADG59664

SEQ ID NO: 157476 - RNA, 1701 nt, Artificial Sequence
  derived and/or modified sequence opt4 from hemagglutinin__InfluenzaA__ADG59666
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcgccguggccagcagccuggugcugguggugagccugggcgccaucagcuucuggaugugcagcaacggcagccugcagugcagaaucugcaucuga

SEQ ID NO: 157477 - RNA, 1701 nt, Artificial Sequence; identical to SEQ ID NO: 156291
  derived and/or modified sequence opt4 from hemagglutinin__InfluenzaA__ADG59667

SEQ ID NO: 157478 - RNA, 1701 nt, Artificial Sequence
  derived and/or modified sequence opt4 from hemagglutinin__InfluenzaA__ADG59669
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggaccccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157479 - RNA, 1701 nt, Artificial Sequence; identical to SEQ ID NO: 157478
  derived and/or modified sequence opt4 from hemagglutinin__InfluenzaA__ADG59670

SEQ ID NO: 157480 - RNA, 1701 nt, Artificial Sequence; identical to SEQ ID NO: 157478
  derived and/or modified sequence opt4 from hemagglutinin__InfluenzaA__ADG59671

SEQ ID NO: 157481 - RNA, 1701 nt, Artificial Sequence; identical to SEQ ID NO: 157478
  derived and/or modified sequence opt4 from hemagglutinin__InfluenzaA__ADG59672

SEQ ID NO: 157482 - RNA, 1701 nt, Artificial Sequence
  derived and/or modified sequence opt4 from hemagglutinin__InfluenzaA__ADG59673
augaaggccauccugguggugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcgagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157483 - RNA, 1701 nt, Artificial Sequence
  derived and/or modified sequence opt4 from hemagglutinin__InfluenzaA__ADG59674
augaaggccauccugguggugcugcuguacaccuucgccaccgccaacgccgacacccugugcgugggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccaagaucuaccagauccuggccaucuacagcaccguggccagcagccuggugcugguggugagccugggcgccaucagcuucuggaugugcagcaacggcagccugcagugcagaaucugcaucuga

SEQ ID NO: 157484 - RNA, 1701 nt, Artificial Sequence
  derived and/or modified sequence opt4 from hemagglutinin__InfluenzaA__ADG59675
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaacggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157485 - RNA, 1701 nt, Artificial Sequence
  derived and/or modified sequence opt4 from hemagglutinin__InfluenzaA__ADG59676
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacgccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157486 - RNA, 1701 nt, Artificial Sequence; identical to SEQ ID NO: 156290
  derived and/or modified sequence opt4 from hemagglutinin__InfluenzaA__ADG59678

SEQ ID NO: 157487 - RNA, 1701 nt, Artificial Sequence; identical to SEQ ID NO: 157453
  derived and/or modified sequence opt4 from hemagglutinin__InfluenzaA__ADG59680

SEQ ID NO: 157488 - RNA, 1701 nt, Artificial Sequence; identical to SEQ ID NO: 157453
  derived and/or modified sequence opt4 from hemagglutinin__InfluenzaA__ADG59681

SEQ ID NO: 157489 - RNA, 1701 nt, Artificial Sequence
  derived and/or modified sequence opt4 from hemagglutinin__InfluenzaA__ADG59683
augaaggccauccugguggugcugcuguacaccuucgccaucgccaacgccgacacccugugcaucggcuaccacgccaacaacagcaccgacaccguggacaccgugcugaagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucgugaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157490 - RNA, 1701 nt, Artificial Sequence; identical to SEQ ID NO: 156290
  derived and/or modified sequence opt4 from hemagglutinin__InfluenzaA__ADG59684

SEQ ID NO: 157491 - RNA, 1701 nt, Artificial Sequence
  derived and/or modified sequence opt4 from hemagglutinin__InfluenzaA__ADG59685
augaaggccauccugguggugcugcuguacaccuucgccaccgccaacgccgacacccugugcaucggcuaccacgccaacaacagcaccgacaccaucgacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157492 - RNA, 1701 nt, Artificial Sequence; identical to SEQ ID NO: 156290
  derived and/or modified sequence opt4 from hemagglutinin__InfluenzaA__ADG59686

SEQ ID NO: 157493 - RNA, 1701 nt, Artificial Sequence; identical to SEQ ID NO: 157453
  derived and/or modified sequence opt4 from hemagglutinin__InfluenzaA__ADG59687

SEQ ID NO: 157494 - RNA, 1701 nt, Artificial Sequence
  derived and/or modified sequence opt4 from hemagglutinin__InfluenzaA__ADG59688
augaaggccauccugguggugcugcuguacaccaucgccaccgccaacgccgacacccugugcaucggcuaccacgccaacaacagcaccgacaccaucgacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157495 - RNA, 1701 nt, Artificial Sequence; identical to SEQ ID NO: 155189
  derived and/or modified sequence opt4 from hemagglutinin__InfluenzaA__ADG59689

SEQ ID NO: 157496 - RNA, 1701 nt, Artificial Sequence; identical to SEQ ID NO: 155189
  derived and/or modified sequence opt4 from hemagglutinin__InfluenzaA__ADG59691

SEQ ID NO: 157497 - RNA, 1701 nt, Artificial Sequence
  derived and/or modified sequence opt4 from hemagglutinin__InfluenzaA__ADG59693
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaaaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157498 - RNA, 1701 nt, Artificial Sequence
  derived and/or modified sequence opt4 from hemagglutinin__InfluenzaA__ADG59696
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157499 - RNA, 1701 nt, Artificial Sequence
  derived and/or modified sequence opt4 from hemagglutinin__InfluenzaA__ADG59697
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagaacuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157500 - RNA, 1701 nt, Artificial Sequence
  derived and/or modified sequence opt4 from hemagglutinin__InfluenzaA__ADG59700
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccugaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157501 - RNA, 1701 nt, Artificial Sequence
  derived and/or modified sequence opt4 from hemagglutinin__InfluenzaA__ADG59701
augaaggccauccugguggugcugcuguacaccuucgccgccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157502 - RNA, 1701 nt, Artificial Sequence
  derived and/or modified sequence opt4 from hemagglutinin__InfluenzaA__ADG59702
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaaaccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157503 - RNA, 1701 nt, Artificial Sequence
  derived and/or modified sequence opt4 from hemagglutinin__InfluenzaA__ADG59703
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucgugaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157504 - RNA, 1701 nt, Artificial Sequence; identical to SEQ ID NO: 155204
  derived and/or modified sequence opt4 from hemagglutinin__InfluenzaA__ADG76646

SEQ ID NO: 157505 - RNA, 1701 nt, Artificial Sequence
  derived and/or modified sequence opt4 from hemagglutinin__InfluenzaA__ADG76652
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagcuucagcaccagcagcagcuggagcuacaucguggagacccccagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacaccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157506 - RNA, 1701 nt, Artificial Sequence; identical to SEQ ID NO: 155431
  derived and/or modified sequence opt4 from hemagglutinin__InfluenzaA__ADH01808

SEQ ID NO: 157507 - RNA, 1701 nt, Artificial Sequence
  derived and/or modified sequence opt4 from hemagglutinin__InfluenzaA__ADH01818
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugaucgugagccugggcgccaucagcuucuggaugugcagcaacggcagccugcagugcagaaucugcaucuga

SEQ ID NO: 157508 - RNA, 1701 nt, Artificial Sequence; identical to SEQ ID NO: 155431
  derived and/or modified sequence opt4 from hemagglutinin__InfluenzaA__ADH01828

SEQ ID NO: 157509 - RNA, 1701 nt, Artificial Sequence; identical to SEQ ID NO: 155189
  derived and/or modified sequence opt4 from hemagglutinin__InfluenzaA__ADH01838

SEQ ID NO: 157510 - RNA, 1701 nt, Artificial Sequence; identical to SEQ ID NO: 155431
  derived and/or modified sequence opt4 from hemagglutinin__InfluenzaA__ADH01848

SEQ ID NO: 157511 - RNA, 1701 nt, Artificial Sequence; identical to SEQ ID NO: 155431
  derived and/or modified sequence opt4 from hemagglutinin__InfluenzaA__ADH01858

SEQ ID NO: 157512 - RNA, 1701 nt, Artificial Sequence; identical to SEQ ID NO: 155189
  derived and/or modified sequence opt4 from hemagglutinin__InfluenzaA__ADH01868

SEQ ID NO: 157513 - RNA, 1701 nt, Artificial Sequence; identical to SEQ ID NO: 155189
  derived and/or modified sequence opt4 from hemagglutinin__InfluenzaA__ADH01878

SEQ ID NO: 157514 - RNA, 1701 nt, Artificial Sequence; identical to SEQ ID NO: 155431
  derived and/or modified sequence opt4 from hemagglutinin__InfluenzaA__ADH01888

SEQ ID NO: 157515 - RNA, 1701 nt, Artificial Sequence; identical to SEQ ID NO: 155189
  derived and/or modified sequence opt4 from hemagglutinin__InfluenzaA__ADH01898

SEQ ID NO: 157516 - RNA, 1701 nt, Artificial Sequence; identical to SEQ ID NO: 155280
  derived and/or modified sequence opt4 from hemagglutinin__InfluenzaA__ADH01908

SEQ ID NO: 157517 - RNA, 1701 nt, Artificial Sequence
  derived and/or modified sequence opt4 from hemagglutinin__InfluenzaA__ADH01918
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgagagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaaggagaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157518 - RNA, 1701 nt, Artificial Sequence
  derived and/or modified sequence opt4 from hemagglutinin__InfluenzaA__ADH01928
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgccagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157519 - RNA, 1701 nt, Artificial Sequence
  derived and/or modified sequence opt4 from hemagglutinin__InfluenzaA__ADH01938
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacaagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157520 - RNA, 1701 nt, Artificial Sequence; identical to SEQ ID NO: 156353
  derived and/or modified sequence opt4 from hemagglutinin__InfluenzaA__ADH01948

SEQ ID NO: 157521 - RNA, 1701 nt, Artificial Sequence
  derived and/or modified sequence opt4 from hemagglutinin__InfluenzaA__ADH01958
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaacugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugaucgugagccugggcgccaucagcuucuggaugugcagcaacggcagccugcagugcagaaucugcaucuga

SEQ ID NO: 157522 - RNA, 1701 nt, Artificial Sequence
  derived and/or modified sequence opt4 from hemagglutinin__InfluenzaA__ADH01968
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157523 - RNA, 1701 nt, Artificial Sequence; identical to SEQ ID NO: 156353
  derived and/or modified sequence opt4 from hemagglutinin__InfluenzaA__ADH01978

SEQ ID NO: 157524 - RNA, 1701 nt, Artificial Sequence; identical to SEQ ID NO: 156353
  derived and/or modified sequence opt4 from hemagglutinin__InfluenzaA__ADH01988

SEQ ID NO: 157525 - RNA, 1701 nt, Artificial Sequence; identical to SEQ ID NO: 157356
  derived and/or modified sequence opt4 from hemagglutinin__InfluenzaA__ADH01998

SEQ ID NO: 157526 - RNA, 1701 nt, Artificial Sequence
  derived and/or modified sequence opt4 from hemagglutinin__InfluenzaA__ADH02008
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggagggcaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcugaucaagaagggcaacagcuaccccaagcugagcaagagcuacaucaacgacaaggagaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157527 - RNA, 1701 nt, Artificial Sequence; identical to SEQ ID NO: 156353
  derived and/or modified sequence opt4 from hemagglutinin__InfluenzaA__ADI24508

SEQ ID NO: 157528 - RNA, 1701 nt, Artificial Sequence
  derived and/or modified sequence opt4 from hemagglutinin__InfluenzaA__ADI24515
augaaggccauccugguggugcugcuguacaccuucgccaccgccaacgccgacacccugugcgugggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugcccaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagagcaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157529 - RNA, 1701 nt, Artificial Sequence; identical to SEQ ID NO: 156353
  derived and/or modified sequence opt4 from hemagglutinin__InfluenzaA__ADI24517

SEQ ID NO: 157530 - RNA, 1701 nt, Artificial Sequence; identical to SEQ ID NO: 156353
  derived and/or modified sequence opt4 from hemagglutinin__InfluenzaA__ADI24519

SEQ ID NO: 157531 - RNA, 1701 nt, Artificial Sequence; identical to SEQ ID NO: 156353
  derived and/or modified sequence opt4 from hemagglutinin__InfluenzaA__ADI24521

SEQ ID NO: 157532 - RNA, 1701 nt, Artificial Sequence; identical to SEQ ID NO: 156741
  derived and/or modified sequence opt4 from hemagglutinin__InfluenzaA__ADI24523

SEQ ID NO: 157533 - RNA, 1701 nt, Artificial Sequence
  derived and/or modified sequence opt4 from hemagglutinin__InfluenzaA__ADI24525
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcgagcugagaggcguggccccccugcaccugggcaagugcaacaucgccggcuggauccugggcaaccccgagugcgagagccugagcaccgccagaagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugaagagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157534 - RNA, 1701 nt, Artificial Sequence; identical to SEQ ID NO: 156353
  derived and/or modified sequence opt4 from hemagglutinin__InfluenzaA__ADI24527

SEQ ID NO: 157535 - RNA, 1701 nt, Artificial Sequence; identical to SEQ ID NO: 156741
  derived and/or modified sequence opt4 from hemagglutinin__InfluenzaA__ADI24529

SEQ ID NO: 157536 - RNA, 1701 nt, Artificial Sequence
  derived and/or modified sequence opt4 from hemagglutinin__InfluenzaA__ADI24531
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccugcugggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcaagaucugcaucuga

SEQ ID NO: 157537 - RNA, 1701 nt, Artificial Sequence
  derived and/or modified sequence opt4 from hemagglutinin__InfluenzaA__ADI24536
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagagacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157538 - RNA, 1701 nt, Artificial Sequence; identical to SEQ ID NO: 156353
  derived and/or modified sequence opt4 from hemagglutinin__InfluenzaA__ADI24546

SEQ ID NO: 157539 - RNA, 1701 nt, Artificial Sequence; identical to SEQ ID NO: 156353
  derived and/or modified sequence opt4 from hemagglutinin__InfluenzaA__ADI24553

SEQ ID NO: 157540 - RNA, 1701 nt, Artificial Sequence; identical to SEQ ID NO: 156353
  derived and/or modified sequence opt4 from hemagglutinin__InfluenzaA__ADI24555

SEQ ID NO: 157541 - RNA, 1701 nt, Artificial Sequence
  derived and/or modified sequence opt4 from hemagglutinin__InfluenzaA__ADI24557
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggagauccuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157542 - RNA, 1701 nt, Artificial Sequence; identical to SEQ ID NO: 156353
  derived and/or modified sequence opt4 from hemagglutinin__InfluenzaA__ADI24559

SEQ ID NO: 157543 - RNA, 1701 nt, Artificial Sequence
  derived and/or modified sequence opt4 from hemagglutinin__InfluenzaA__ADI24561
augaaggccauccuggugauccugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacgacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157544 - RNA, 1701 nt, Artificial Sequence; identical to SEQ ID NO: 156353
  derived and/or modified sequence opt4 from hemagglutinin__InfluenzaA__ADI24563

SEQ ID NO: 157545 - RNA, 1701 nt, Artificial Sequence
  derived and/or modified sequence opt4 from hemagglutinin__InfluenzaA__ADI24565
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacgacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaagaaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157546 - RNA, 1701 nt, Artificial Sequence; identical to SEQ ID NO: 156353
  derived and/or modified sequence opt4 from hemagglutinin__InfluenzaA__ADI24567

SEQ ID NO: 157547 - RNA, 1701 nt, Artificial Sequence
  derived and/or modified sequence opt4 from hemagglutinin__InfluenzaA__ADI24569
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccaucgagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157548 - RNA, 1701 nt, Artificial Sequence; identical to SEQ ID NO: 156353
  derived and/or modified sequence opt4 from hemagglutinin__InfluenzaA__ADI24571

SEQ ID NO: 157549 - RNA, 1701 nt, Artificial Sequence; identical to SEQ ID NO: 156741
  derived and/or modified sequence opt4 from hemagglutinin__InfluenzaA__ADI24573

SEQ ID NO: 157550 - RNA, 1701 nt, Artificial Sequence
  derived and/or modified sequence opt4 from hemagglutinin__InfluenzaA__ADI24575
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacguggagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157551 - RNA, 1701 nt, Artificial Sequence; identical to SEQ ID NO: 156353
  derived and/or modified sequence opt4 from hemagglutinin__InfluenzaA__ADI24577

SEQ ID NO: 157552 - RNA, 1701 nt, Artificial Sequence
  derived and/or modified sequence opt4 from hemagglutinin__InfluenzaA__ADI24581
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcugggugcugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157553 - RNA, 1701 nt, Artificial Sequence
  derived and/or modified sequence opt4 from hemagglutinin__InfluenzaA__ADI24583
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157554 - RNA, 1701 nt, Artificial Sequence
  derived and/or modified sequence opt4 from hemagglutinin__InfluenzaA__ADI24590
augaaggccauccugguggugcugcuguacaccuucgccaccgccaacgccgacacccugugcaucggcuaccacgccaacaacagcaccgacaccguggacaccgugcuggagaagaacgugaccgugacccacagcgccaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157555 - RNA, 1701 nt, Artificial Sequence
  derived and/or modified sequence opt4 from hemagglutinin__InfluenzaA__ADI24597
augaaggccauccugguggugcugcuguacaccuucgccaccgccaacgccgacacccugugcaucggcuaccacgccaacaacagcaccgacaccguggacaccgugcuggagaagaacgugaccgugacccacagcgccaaccugcuggaggacaagcacaacggcaagcugugcaagcugagaggcguggccccccugcaccugggcaacugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157556 - RNA, 1701 nt, Artificial Sequence; identical to SEQ ID NO: 157554
  derived and/or modified sequence opt4 from hemagglutinin__InfluenzaA__ADI24612

SEQ ID NO: 157557 - RNA, 1701 nt, Artificial Sequence
  derived and/or modified sequence opt4 from hemagglutinin__InfluenzaA__ADI24619
augaaggccauccugguggugcugcuguacaccuucgccaccgccaacgccgacacccugugcaucggcuaccacgccaacaacagcaccgacaccguggacaccgugcuggagaagaacgugaccgugacccacagcgccaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcguggaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157558 - RNA, 1701 nt, Artificial Sequence
  derived and/or modified sequence opt4 from hemagglutinin__InfluenzaA__ADI24621
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcaccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugaucgugagccugggcgccaucagcuucuggaugugcagcaacggcagccugcagugcagaaucugcaucuga

SEQ ID NO: 157559 - RNA, 1701 nt, Artificial Sequence
  derived and/or modified sequence opt4 from hemagglutinin__InfluenzaA__ADI48184
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccaugggcagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagagagugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157560 - RNA, 1701 nt, Artificial Sequence; identical to SEQ ID NO: 156353
  derived and/or modified sequence opt4 from hemagglutinin__InfluenzaA__ADI48186

SEQ ID NO: 157561 - RNA, 1701 nt, Artificial Sequence
  derived and/or modified sequence opt4 from hemagglutinin__InfluenzaA__ADI48188
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcgacaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157562 - RNA, 1701 nt, Artificial Sequence
  derived and/or modified sequence opt4 from hemagglutinin__InfluenzaA__ADI48190
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccaagaucuaccagauccuggccaucuacagcaccguggccagcagccuggugcugguggugagccugggcgccaucagcuucuggaugugcagcaacggcagccugcagugcagaaucugcaucuga

SEQ ID NO: 157563 - RNA, 1701 nt, Artificial Sequence
  derived and/or modified sequence opt4 from hemagglutinin__InfluenzaA__ADI48192
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccugaccaucuacagcaccguggccagcagccuggugcugguggugagccugggcgccaucagcuucuggaugugcagcaacggcagccugcagugcagaaucugcaucuga

SEQ ID NO: 157564 - RNA, 1701 nt, Artificial Sequence
  derived and/or modified sequence opt4 from hemagglutinin__InfluenzaA__ADI48194
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagccuggugagcagcuucgagagauucgagaucuuccccaagaccaacagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157565 - RNA, 1701 nt, Artificial Sequence
  derived and/or modified sequence opt4 from hemagglutinin__InfluenzaA__ADI48196
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggacagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157566 - RNA, 1701 nt, Artificial Sequence; identical to SEQ ID NO: 156353
  derived and/or modified sequence opt4 from hemagglutinin__InfluenzaA__ADI48198

SEQ ID NO: 157567 - RNA, 1701 nt, Artificial Sequence; identical to SEQ ID NO: 156353
  derived and/or modified sequence opt4 from hemagglutinin__InfluenzaA__ADI48200

SEQ ID NO: 157568 - RNA, 1701 nt, Artificial Sequence
  derived and/or modified sequence opt4 from hemagglutinin__InfluenzaA__ADI48202
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaucagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157569 - RNA, 1701 nt, Artificial Sequence
  derived and/or modified sequence opt4 from hemagglutinin__InfluenzaA__ADI48204
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacguggacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaagaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157570 - RNA, 1701 nt, Artificial Sequence; identical to SEQ ID NO: 156353
  derived and/or modified sequence opt4 from hemagglutinin__InfluenzaA__ADI48208

SEQ ID NO: 157571 - RNA, 1701 nt, Artificial Sequence; identical to SEQ ID NO: 156353
  derived and/or modified sequence opt4 from hemagglutinin__InfluenzaA__ADI48210

SEQ ID NO: 157572 - RNA, 1701 nt, Artificial Sequence
  derived and/or modified sequence opt4 from hemagglutinin__InfluenzaA__ADI48212
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacguguggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157573 - RNA, 1701 nt, Artificial Sequence
  derived and/or modified sequence opt4 from hemagglutinin__InfluenzaA__ADI48214
augaaggccauccugguggugcugcuguacaccuucgccaucgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcuggccgugagccugggcgccaucagcuucuggaugugcagcaacggcagccugcagugcagaaucugcaucuga

SEQ ID NO: 157574 - RNA, 1701 nt, Artificial Sequence; identical to SEQ ID NO: 157572
  derived and/or modified sequence opt4 from hemagglutinin__InfluenzaA__ADI48216

SEQ ID NO: 157575 - RNA, 1701 nt, Artificial Sequence
  derived and/or modified sequence opt4 from hemagglutinin__InfluenzaA__ADI48218
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccaggacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157576 - RNA, 1701 nt, Artificial Sequence
  derived and/or modified sequence opt4 from hemagglutinin__InfluenzaA__ADI48220
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgagaccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccugggcuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157577 - RNA, 1701 nt, Artificial Sequence
  derived and/or modified sequence opt4 from hemagglutinin__InfluenzaA__ADI48622
augaaggccauccugguguuccugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157578 - RNA, 1701 nt, Artificial Sequence
  derived and/or modified sequence opt4 from hemagglutinin__InfluenzaA__ADI48632
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcgugcaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157579 - RNA, 1701 nt, Artificial Sequence; identical to SEQ ID NO: 155431
  derived and/or modified sequence opt4 from hemagglutinin__InfluenzaA__ADI48642

SEQ ID NO: 157580 - RNA, 1701 nt, Artificial Sequence; identical to SEQ ID NO: 155431
  derived and/or modified sequence opt4 from hemagglutinin__InfluenzaA__ADI48652

SEQ ID NO: 157581 - RNA, 1701 nt, Artificial Sequence
  derived and/or modified sequence opt4 from hemagglutinin__InfluenzaA__ADI48672
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaacaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157582 - RNA, 1701 nt, Artificial Sequence; identical to SEQ ID NO: 155189
  derived and/or modified sequence opt4 from hemagglutinin__InfluenzaA__ADI48682

SEQ ID NO: 157583 - RNA, 1701 nt, Artificial Sequence; identical to SEQ ID NO: 155431
  derived and/or modified sequence opt4 from hemagglutinin__InfluenzaA__ADI48692

SEQ ID NO: 157584 - RNA, 1701 nt, Artificial Sequence; identical to SEQ ID NO: 155369
  derived and/or modified sequence opt4 from hemagglutinin__InfluenzaA__ADI48702

SEQ ID NO: 157585 - RNA, 1701 nt, Artificial Sequence; identical to SEQ ID NO: 155431
  derived and/or modified sequence opt4 from hemagglutinin__InfluenzaA__ADI48712

SEQ ID NO: 157586 - RNA, 1701 nt, Artificial Sequence; identical to SEQ ID NO: 155431
  derived and/or modified sequence opt4 from hemagglutinin__InfluenzaA__ADI48722

SEQ ID NO: 157587 - RNA, 1701 nt, Artificial Sequence; identical to SEQ ID NO: 155189
  derived and/or modified sequence opt4 from hemagglutinin__InfluenzaA__ADI48732

SEQ ID NO: 157588 - RNA, 1701 nt, Artificial Sequence; identical to SEQ ID NO: 155189
  derived and/or modified sequence opt4 from hemagglutinin__InfluenzaA__ADI48742

SEQ ID NO: 157589 - RNA, 1701 nt, Artificial Sequence
  derived and/or modified sequence opt4 from hemagglutinin__InfluenzaA__ADI48752
auggaggccauccugguguuccugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcaucaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157590 - RNA, 1701 nt, Artificial Sequence; identical to SEQ ID NO: 155431
  derived and/or modified sequence opt4 from hemagglutinin__InfluenzaA__ADI48762

SEQ ID NO: 157591 - RNA, 1701 nt, Artificial Sequence
  derived and/or modified sequence opt4 from hemagglutinin__InfluenzaA__ADI48772
auggaggccauccugguggugcugcuguacaccuucgccaccgccaacgccgacacccugugcaucggcuaccaggccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157592 - RNA, 1701 nt, Artificial Sequence
  derived and/or modified sequence opt4 from hemagglutinin__InfluenzaA__ADI48782
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggagagcaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157593 - RNA, 1701 nt, Artificial Sequence
  derived and/or modified sequence opt4 from hemagglutinin__InfluenzaA__ADI48792
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacaucuucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157594 - RNA, 1701 nt, Artificial Sequence
  derived and/or modified sequence opt4 from hemagglutinin__InfluenzaA__ADI49029
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcaucagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugaagaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157595 - RNA, 1701 nt, Artificial Sequence; identical to SEQ ID NO: 155431
  derived and/or modified sequence opt4 from hemagglutinin__InfluenzaA__ADI49240

SEQ ID NO: 157596 - RNA, 1701 nt, Artificial Sequence; identical to SEQ ID NO: 155431
  derived and/or modified sequence opt4 from hemagglutinin__InfluenzaA__ADI49260

SEQ ID NO: 157597 - RNA, 1701 nt, Artificial Sequence
  derived and/or modified sequence opt4 from hemagglutinin__InfluenzaA__ADI49270
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccagagagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157598 - RNA, 1701 nt, Artificial Sequence; identical to SEQ ID NO: 155431
  derived and/or modified sequence opt4 from hemagglutinin__InfluenzaA__ADI49280

SEQ ID NO: 157599 - RNA, 1701 nt, Artificial Sequence; identical to SEQ ID NO: 155431
  derived and/or modified sequence opt4 from hemagglutinin__InfluenzaA__ADI49312

SEQ ID NO: 157600 - RNA, 1701 nt, Artificial Sequence; identical to SEQ ID NO: 155431
  derived and/or modified sequence opt4 from hemagglutinin__InfluenzaA__ADI49322

SEQ ID NO: 157601 - RNA, 1701 nt, Artificial Sequence; identical to SEQ ID NO: 155431
  derived and/or modified sequence opt4 from hemagglutinin__InfluenzaA__ADI49332

SEQ ID NO: 157602 - RNA, 1701 nt, Artificial Sequence; identical to SEQ ID NO: 155758
  derived and/or modified sequence opt4 from hemagglutinin__InfluenzaA__ADI49342

SEQ ID NO: 157603 - RNA, 1701 nt, Artificial Sequence; identical to SEQ ID NO: 155431
  derived and/or modified sequence opt4 from hemagglutinin__InfluenzaA__ADI49352

SEQ ID NO: 157604 - RNA, 1701 nt, Artificial Sequence; identical to SEQ ID NO: 155189
  derived and/or modified sequence opt4 from hemagglutinin__InfluenzaA__ADI49362

SEQ ID NO: 157605 - RNA, 1701 nt, Artificial Sequence; identical to SEQ ID NO: 156741
  derived and/or modified sequence opt4 from hemagglutinin__InfluenzaA__ADI49382

SEQ ID NO: 157606 - RNA, 1701 nt, Artificial Sequence; identical to SEQ ID NO: 155542
  derived and/or modified sequence opt4 from hemagglutinin__InfluenzaA__ADI49392

SEQ ID NO: 157607 - RNA, 1701 nt, Artificial Sequence; identical to SEQ ID NO: 155176
  derived and/or modified sequence opt4 from hemagglutinin__InfluenzaA__ADI49717

SEQ ID NO: 157608 - RNA, 1701 nt, Artificial Sequence
  derived and/or modified sequence opt4 from hemagglutinin__InfluenzaA__ADI49727
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcaucaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157609 - RNA, 1701 nt, Artificial Sequence; identical to SEQ ID NO: 155176
  derived and/or modified sequence opt4 from hemagglutinin__InfluenzaA__ADI49737

SEQ ID NO: 157610 - RNA, 1701 nt, Artificial Sequence; identical to SEQ ID NO: 155176
  derived and/or modified sequence opt4 from hemagglutinin__InfluenzaA__ADI49747

SEQ ID NO: 157611 - RNA, 1701 nt, Artificial Sequence; identical to SEQ ID NO: 155176
  derived and/or modified sequence opt4 from hemagglutinin__InfluenzaA__ADI49757

SEQ ID NO: 157612 - RNA, 1701 nt, Artificial Sequence; identical to SEQ ID NO: 155176
  derived and/or modified sequence opt4 from hemagglutinin__InfluenzaA__ADI49767

SEQ ID NO: 157613 - RNA, 1701 nt, Artificial Sequence
  derived and/or modified sequence opt4 from hemagglutinin__InfluenzaA__ADI49777
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157614 - RNA, 1701 nt, Artificial Sequence
  derived and/or modified sequence opt4 from hemagglutinin__InfluenzaA__ADI49787
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagcaucagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157615 - RNA, 1701 nt, Artificial Sequence; identical to SEQ ID NO: 156524
  derived and/or modified sequence opt4 from hemagglutinin__InfluenzaA__ADI49822

SEQ ID NO: 157616 - RNA, 1701 nt, Artificial Sequence
  derived and/or modified sequence opt4 from hemagglutinin__InfluenzaA__ADI50027
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaaguacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggccaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcaucaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157617 - RNA, 1701 nt, Artificial Sequence
  derived and/or modified sequence opt4 from hemagglutinin__InfluenzaA__ADI52834
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 157618 - RNA, 1701 nt, Artificial Sequence
  derived and/or modified sequence opt4 from hemagglutinin__InfluenzaA__ADI52835
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccacccccccaccagcgccgaccagcagagccuguaccagaacgccgacgccuacguguucgugggcagcagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccaagaucuaccagauccuggccaucuacagcaccguggccagcagccuggugcugguggugagccugggcgccaucagcuucuggaugugcagcaacggcagccugcagugcagaaucugcaucuga

SEQ ID NO: 157619 - RNA, 1701 nt, Artificial Sequence
  derived and/or modified sequence opt4 from hemagglutinin__InfluenzaA__ADI52836
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaaggagaacagcuaccccaagcugagcaagagcuacaucaacgacaagggcaaggaggugcuggugcuguggggcauccaccaccccagcaccagcgccgaccagcagagacuguaccagaacgccgacgccuacguguucgugggcagcagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccaagaucuaccagauccuggccaucuacagcaccguggccagcagccuggugcugguggugagccugggcgccaucagcuucuggaugugcagcaacggcagccugcagugcagaaucugcaucuga

SEQ ID NO: 157620 - RNA, 1701 nt, Artificial Sequence
  derived and/or modified sequence opt4 from hemagglutinin__InfluenzaA__ADI52837
auggaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggugaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcaaguacagcaagaaguucaagcccgagaucgccaucagacccaaggugagagaccaggagggcagaaugaacuacuacuggacccugguggagcccggcgacaagaucaccuucgaggccaacggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccaagaucuaccagauccuggccaucuacagcaccguggccagcagccuggugcugguggugagccugggcgccaucagcuucuggaugugcagcaacggcagccugcagugcagaaucugcaucuga

SEQ ID NO: 157621 - RNA, 1701 nt, Artificial Sequence; identical to SEQ ID NO: 155987
  derived and/or modified sequence opt4 from hemagglutinin__InfluenzaA__ADI72915

SEQ ID NO: 157622 - RNA, 1701 nt, Artificial Sequence; identical to SEQ ID NO: 155987
  derived and/or modified sequence opt4 from hemagglutinin__InfluenzaA__ADI72916

SEQ ID NO: 157623 - RNA, 1701 nt, Artificial Sequence; identical to SEQ ID NO: 155987
  derived and/or modified sequence opt4 from hemagglutinin__InfluenzaA__ADI72917

SEQ ID NO: 157624 - RNA, 1701 nt, Artificial Sequence
  derived and/or modified sequence opt4 from hemagglutinin__InfluenzaA__ADI72918
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacagaggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaagcuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157625 - RNA, 1701 nt, Artificial Sequence; identical to SEQ ID NO: 155987
  derived and/or modified sequence opt4 from hemagglutinin__InfluenzaA__ADI72919

SEQ ID NO: 157626 - RNA, 1701 nt, Artificial Sequence; identical to SEQ ID NO: 155987
  derived and/or modified sequence opt4 from hemagglutinin__InfluenzaA__ADI72920

SEQ ID NO: 157627 - RNA, 1701 nt, Artificial Sequence
  derived and/or modified sequence opt4 from hemagglutinin__InfluenzaA__ADI72921
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgcccuggacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157628 - RNA, 1701 nt, Artificial Sequence; identical to SEQ ID NO: 155189
  derived and/or modified sequence opt4 from hemagglutinin__InfluenzaA__ADI72922

SEQ ID NO: 157629 - RNA, 1701 nt, Artificial Sequence
  derived and/or modified sequence opt4 from hemagglutinin__InfluenzaA__ADI72923
augaaggccauccugguggugcugcuguacaccuucgccaccagcaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggccccggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157630 - RNA, 1701 nt, Artificial Sequence; identical to SEQ ID NO: 155987
  derived and/or modified sequence opt4 from hemagglutinin__InfluenzaA__ADI72924

SEQ ID NO: 157631 - RNA, 1701 nt, Artificial Sequence; identical to SEQ ID NO: 155189
  derived and/or modified sequence opt4 from hemagglutinin__InfluenzaA__ADI72925

SEQ ID NO: 157632 - RNA, 1701 nt, Artificial Sequence
  derived and/or modified sequence opt4 from hemagglutinin__InfluenzaA__ADI72926
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcggcuacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157633 - RNA, 1701 nt, Artificial Sequence
  derived and/or modified sequence opt4 from hemagglutinin__InfluenzaA__ADI72927
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaccagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157634 - RNA, 1701 nt, Artificial Sequence
  derived and/or modified sequence opt4 from hemagglutinin__InfluenzaA__ADI72928
augaaggccauccugguggugcugcuguacaccuucgccaccgccaacgccgacacccugugcaucggcuaccacgccaacaacagcaccgacaccguggacaccauccuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagaaaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157635 - RNA, 1701 nt, Artificial Sequence; identical to SEQ ID NO: 155189
  derived and/or modified sequence opt4 from hemagglutinin__InfluenzaA__ADI72929

SEQ ID NO: 157636 - RNA, 1701 nt, Artificial Sequence; identical to SEQ ID NO: 155189
  derived and/or modified sequence opt4 from hemagglutinin__InfluenzaA__ADI72930

SEQ ID NO: 157637 - RNA, 1701 nt, Artificial Sequence
  derived and/or modified sequence opt4 from hemagglutinin__InfluenzaA__ADI72931
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcaucaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157638 - RNA, 1701 nt, Artificial Sequence; identical to SEQ ID NO: 156845
  derived and/or modified sequence opt4 from hemagglutinin__InfluenzaA__ADI72932

SEQ ID NO: 157639 - RNA, 1698 nt, Artificial Sequence
  derived and/or modified sequence opt4 from hemagglutinin__InfluenzaA__ADI75818
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacaagaaccugcuguggcugaccgagaagaacggccuguaccccaaccugagcaagagcuacgccaacaacaaggagaaggaggugcuggugcuguggggcgugcaccacccccccagcaucagcgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 157640 - RNA, 1698 nt, Artificial Sequence
  derived and/or modified sequence opt4 from hemagglutinin__InfluenzaA__ADI75851
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcggccugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagagcagcuucuacagaaaccugcuguggcugaccggcaagaacggccuguaccccaaccugagcaagagcuacgccaacaacaaggagaaggaggugcuggugcuguggggcgugcaccacccccccaacaucguggaccagaagacccuguacagaaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccaugggcaagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 157641 - RNA, 1701 nt, Artificial Sequence; identical to SEQ ID NO: 154954
  derived and/or modified sequence opt4 from hemagglutinin__InfluenzaA__ADI75884

SEQ ID NO: 157642 - RNA, 1701 nt, Artificial Sequence; identical to SEQ ID NO: 154954
  derived and/or modified sequence opt4 from hemagglutinin__InfluenzaA__ADI75917

SEQ ID NO: 157643 - RNA, 1698 nt, Artificial Sequence
  derived and/or modified sequence opt4 from hemagglutinin__InfluenzaA__ADI77349
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcgagaacagcuucuacagaaaccugcuguggcugaccggcaagaacggccuguaccccaaccugagcaagagcuacgccaacaacaaggagaaggaggugcugauccuguggggcgugcaccacccccccaacauggccgaccagaagacccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacaagugcgacaccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 157644 - RNA, 1701 nt, Artificial Sequence; identical to SEQ ID NO: 155189
  derived and/or modified sequence opt4 from hemagglutinin__InfluenzaA__ADI77360

SEQ ID NO: 157645 - RNA, 1701 nt, Artificial Sequence
  derived and/or modified sequence opt4 from hemagglutinin__InfluenzaA__ADI99498
augaagaccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccuggugaagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157646 - RNA, 1701 nt, Artificial Sequence
  derived and/or modified sequence opt4 from hemagglutinin__InfluenzaA__ADI99560
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcaacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157647 - RNA, 1701 nt, Artificial Sequence; identical to SEQ ID NO: 157646
  derived and/or modified sequence opt4 from hemagglutinin__InfluenzaA__ADI99570

SEQ ID NO: 157648 - RNA, 1701 nt, Artificial Sequence; identical to SEQ ID NO: 157646
  derived and/or modified sequence opt4 from hemagglutinin__InfluenzaA__ADI99580

SEQ ID NO: 157649 - RNA, 1701 nt, Artificial Sequence; identical to SEQ ID NO: 156802
  derived and/or modified sequence opt4 from hemagglutinin__InfluenzaA__ADI99590

SEQ ID NO: 157650 - RNA, 1701 nt, Artificial Sequence
  derived and/or modified sequence opt4 from hemagglutinin__InfluenzaA__ADI99610
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggagauccuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157651 - RNA, 1701 nt, Artificial Sequence
  derived and/or modified sequence opt4 from hemagglutinin__InfluenzaA__ADI99620
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucaccgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157652 - RNA, 1701 nt, Artificial Sequence
  derived and/or modified sequence opt4 from hemagglutinin__InfluenzaA__ADI99630
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagaacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcaacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157653 - RNA, 1701 nt, Artificial Sequence
  derived and/or modified sequence opt4 from hemagglutinin__InfluenzaA__ADI99640
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacagcuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccauccacgacugcaacaccaccugccagacccccgagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157654 - RNA, 1701 nt, Artificial Sequence; identical to SEQ ID NO: 156741
  derived and/or modified sequence opt4 from hemagglutinin__InfluenzaA__ADI99660

SEQ ID NO: 157655 - RNA, 1701 nt, Artificial Sequence
  derived and/or modified sequence opt4 from hemagglutinin__InfluenzaA__ADI99670
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacggcuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157656 - RNA, 1701 nt, Artificial Sequence
  derived and/or modified sequence opt4 from hemagglutinin__InfluenzaA__ADI99680
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggaccaucguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157657 - RNA, 1701 nt, Artificial Sequence
  derived and/or modified sequence opt4 from hemagglutinin__InfluenzaA__ADI99690
augaaggccauccuggccgugcugcuguacaccuucgccaucgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaagaaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157658 - RNA, 1701 nt, Artificial Sequence
  derived and/or modified sequence opt4 from hemagglutinin__InfluenzaA__ADI99700
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgugagcccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcgugcaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggcccccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157659 - RNA, 1701 nt, Artificial Sequence; identical to SEQ ID NO: 156838
  derived and/or modified sequence opt4 from hemagglutinin__InfluenzaA__ADI99710

SEQ ID NO: 157660 - RNA, 1701 nt, Artificial Sequence
  derived and/or modified sequence opt4 from hemagglutinin__InfluenzaA__ADI99720
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccgaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugagcagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157661 - RNA, 1701 nt, Artificial Sequence; identical to SEQ ID NO: 155189
  derived and/or modified sequence opt4 from hemagglutinin__InfluenzaA__ADI99730

SEQ ID NO: 157662 - RNA, 1701 nt, Artificial Sequence; identical to SEQ ID NO: 155189
  derived and/or modified sequence opt4 from hemagglutinin__InfluenzaA__ADJ00497

SEQ ID NO: 157663 - RNA, 1701 nt, Artificial Sequence; identical to SEQ ID NO: 155189
  derived and/or modified sequence opt4 from hemagglutinin__InfluenzaA__ADJ00498

SEQ ID NO: 157664 - RNA, 1701 nt, Artificial Sequence; identical to SEQ ID NO: 156383
  derived and/or modified sequence opt4 from hemagglutinin__InfluenzaA__ADJ00501

SEQ ID NO: 157665 - RNA, 1701 nt, Artificial Sequence; identical to SEQ ID NO: 156353
  derived and/or modified sequence opt4 from hemagglutinin__InfluenzaA__ADJ18163

SEQ ID NO: 157666 - RNA, 1701 nt, Artificial Sequence; identical to SEQ ID NO: 156353
  derived and/or modified sequence opt4 from hemagglutinin__InfluenzaA__ADJ18165

SEQ ID NO: 157667 - RNA, 1701 nt, Artificial Sequence
  derived and/or modified sequence opt4 from hemagglutinin__InfluenzaA__ADJ18167
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugccccuacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157668 - RNA, 1701 nt, Artificial Sequence
  derived and/or modified sequence opt4 from hemagglutinin__InfluenzaA__ADJ18169
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagacagagagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157669 - RNA, 1701 nt, Artificial Sequence
  derived and/or modified sequence opt4 from hemagglutinin__InfluenzaA__ADJ18171
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggcccuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuaccagaaccugaucuggcuggugaagaagggcaacagcuaccccaagcugagcaagagcuacauccacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagacagacagggcagaaugaacuacuacuggacccugguggagcugggcgacaagaucaccuucgaggccaccggcaaccugguggugcccagauacgccuucgccauggagagaaacgccggcagcggcaucaucaucagcgacacccccgugcacaacugcaacaccaccugccagaccaccaccggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157670 - RNA, 1701 nt, Artificial Sequence; identical to SEQ ID NO: 156353
  derived and/or modified sequence opt4 from hemagglutinin__InfluenzaA__ADJ18173

SEQ ID NO: 157671 - RNA, 1701 nt, Artificial Sequence; identical to SEQ ID NO: 156353
  derived and/or modified sequence opt4 from hemagglutinin__InfluenzaA__ADJ18175

SEQ ID NO: 157672 - RNA, 1701 nt, Artificial Sequence
  derived and/or modified sequence opt4 from hemagglutinin__InfluenzaA__ADJ18177
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaggccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcgugcagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157673 - RNA, 1701 nt, Artificial Sequence
  derived and/or modified sequence opt4 from hemagglutinin__InfluenzaA__ADJ40444
augaaggccauccugguggugcugcuguacaccuucgccaccgccaacgccgacacccugugcaucggcuaccacgccaacaacagcaccgacaccguggacaccgugcugaagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157674 - RNA, 1701 nt, Artificial Sequence
  derived and/or modified sequence opt4 from hemagglutinin__InfluenzaA__ADJ40454
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaaaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcguggagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157675 - RNA, 1701 nt, Artificial Sequence
  derived and/or modified sequence opt4 from hemagglutinin__InfluenzaA__ADJ40464
augaaggccauccugguggugcugcuguacaccuucgccaccgccaacaccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcugauccugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157676 - RNA, 1701 nt, Artificial Sequence
  derived and/or modified sequence opt4 from hemagglutinin__InfluenzaA__ADJ40474
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagacagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157677 - RNA, 1701 nt, Artificial Sequence
  derived and/or modified sequence opt4 from hemagglutinin__InfluenzaA__ADJ40494
augaaggccauccugguggugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagacccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157678 - RNA, 1701 nt, Artificial Sequence
  derived and/or modified sequence opt4 from hemagglutinin__InfluenzaA__ADJ40514
augaaggccgugcugguggugcugcuguacaccuucgccaccaccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaaaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157679 - RNA, 1701 nt, Artificial Sequence; identical to SEQ ID NO: 155189
  derived and/or modified sequence opt4 from hemagglutinin__InfluenzaA__ADJ40524

SEQ ID NO: 157680 - RNA, 1701 nt, Artificial Sequence; identical to SEQ ID NO: 155542
  derived and/or modified sequence opt4 from hemagglutinin__InfluenzaA__ADJ40534

SEQ ID NO: 157681 - RNA, 1701 nt, Artificial Sequence
  derived and/or modified sequence opt4 from hemagglutinin__InfluenzaA__ADJ40554
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaacaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157682 - RNA, 1701 nt, Artificial Sequence; identical to SEQ ID NO: 155189
  derived and/or modified sequence opt4 from hemagglutinin__InfluenzaA__ADJ40564

SEQ ID NO: 157683 - RNA, 1701 nt, Artificial Sequence; identical to SEQ ID NO: 155189
  derived and/or modified sequence opt4 from hemagglutinin__InfluenzaA__ADJ40574

SEQ ID NO: 157684 - RNA, 1701 nt, Artificial Sequence; identical to SEQ ID NO: 156609
  derived and/or modified sequence opt4 from hemagglutinin__InfluenzaA__ADJ40584

SEQ ID NO: 157685 - RNA, 1701 nt, Artificial Sequence; identical to SEQ ID NO: 155189
  derived and/or modified sequence opt4 from hemagglutinin__InfluenzaA__ADJ40594

SEQ ID NO: 157686 - RNA, 1701 nt, Artificial Sequence; identical to SEQ ID NO: 155758
  derived and/or modified sequence opt4 from hemagglutinin__InfluenzaA__ADJ40604

SEQ ID NO: 157687 - RNA, 1701 nt, Artificial Sequence; identical to SEQ ID NO: 155758
  derived and/or modified sequence opt4 from hemagglutinin__InfluenzaA__ADJ40614

SEQ ID NO: 157688 - RNA, 1701 nt, Artificial Sequence; identical to SEQ ID NO: 155189
  derived and/or modified sequence opt4 from hemagglutinin__InfluenzaA__ADJ40634

SEQ ID NO: 157689 - RNA, 1701 nt, Artificial Sequence; identical to SEQ ID NO: 155189
  derived and/or modified sequence opt4 from hemagglutinin__InfluenzaA__ADJ40644

SEQ ID NO: 157690 - RNA, 1701 nt, Artificial Sequence; identical to SEQ ID NO: 155189
  derived and/or modified sequence opt4 from hemagglutinin__InfluenzaA__ADJ40654

SEQ ID NO: 157691 - RNA, 1701 nt, Artificial Sequence; identical to SEQ ID NO: 155189
  derived and/or modified sequence opt4 from hemagglutinin__InfluenzaA__ADJ40664

SEQ ID NO: 157692 - RNA, 1701 nt, Artificial Sequence; identical to SEQ ID NO: 155189
  derived and/or modified sequence opt4 from hemagglutinin__InfluenzaA__ADJ40674

SEQ ID NO: 157693 - RNA, 1701 nt, Artificial Sequence
  derived and/or modified sequence opt4 from hemagglutinin__InfluenzaA__ADJ41816
augaagaccaucaucgcccugagcuacauguucugccugguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcugcaccugcaagagaggcagcaacgacagcuucuucagcagacugaacuggcuguacgagagcgagagcaaguaccccgugcugaacgugaccaugcccaacaacggcaaguucgacaagcuguacaucuggggcauccaccaccccagcaccgacaaggagcagaccaaccuguacaucagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucagcagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 157694 - RNA, 1701 nt, Artificial Sequence; identical to SEQ ID NO: 155189
  derived and/or modified sequence opt4 from hemagglutinin__InfluenzaA__ADJ56640

SEQ ID NO: 157695 - RNA, 1701 nt, Artificial Sequence; identical to SEQ ID NO: 155987
  derived and/or modified sequence opt4 from hemagglutinin__InfluenzaA__ADJ56650

SEQ ID NO: 157696 - RNA, 1701 nt, Artificial Sequence; identical to SEQ ID NO: 155280
  derived and/or modified sequence opt4 from hemagglutinin__InfluenzaA__ADJ67983

SEQ ID NO: 157697 - RNA, 1701 nt, Artificial Sequence; identical to SEQ ID NO: 155280
  derived and/or modified sequence opt4 from hemagglutinin__InfluenzaA__ADJ67984

SEQ ID NO: 157698 - RNA, 1701 nt, Artificial Sequence; identical to SEQ ID NO: 155280
  derived and/or modified sequence opt4 from hemagglutinin__InfluenzaA__ADJ67985

SEQ ID NO: 157699 - RNA, 1701 nt, Artificial Sequence
  derived and/or modified sequence opt4 from hemagglutinin__InfluenzaA__ADJ80241
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagaaaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157700 - RNA, 1701 nt, Artificial Sequence
  derived and/or modified sequence opt4 from hemagglutinin__InfluenzaA__ADJ80242
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 157701 - RNA, 1701 nt, Artificial Sequence; identical to SEQ ID NO: 156741
  derived and/or modified sequence opt4 from hemagglutinin__InfluenzaA__ADJ80243

SEQ ID NO: 157702 - RNA, 1701 nt, Artificial Sequence; identical to SEQ ID NO: 155189
  derived and/or modified sequence opt4 from hemagglutinin__InfluenzaA__ADJ80634

SEQ ID NO: 157703 - RNA, 1701 nt, Artificial Sequence; identical to SEQ ID NO: 157191
  derived and/or modified sequence opt4 from hemagglutinin__InfluenzaA__ADJ80644

SEQ ID NO: 157704 - RNA, 1701 nt, Artificial Sequence; identical to SEQ ID NO: 157191
  derived and/or modified sequence opt4 from hemagglutinin__InfluenzaA__ADJ80654

SEQ ID NO: 157705 - RNA, 1701 nt, Artificial Sequence; identical to SEQ ID NO: 156353
  derived and/or modified sequence opt4 from hemagglutinin__InfluenzaA__ADJ80674

SEQ ID NO: 157706 - RNA, 1701 nt, Artificial Sequence; identical to SEQ ID NO: 156353
  derived and/or modified sequence opt4 from hemagglutinin__InfluenzaA__ADJ80684

SEQ ID NO: 157707 - RNA, 1701 nt, Artificial Sequence
  derived and/or modified sequence opt4 from hemagglutinin__InfluenzaA__ADJ80694
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaaccacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 157708 - RNA, 1701 nt, Artificial Sequence; identical to SEQ ID NO: 156353
  derived and/or modified sequence opt4 from hemagglutinin__InfluenzaA__ADJ80704

SEQ ID NO: 157709 - RNA, 1701 nt, Artificial Sequence
  derived and/or modified sequence opt4 from hemagglutinin__InfluenzaA__ADJ80714
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcgccgccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157710 - RNA, 1701 nt, Artificial Sequence; identical to SEQ ID NO: 155189
  derived and/or modified sequence opt4 from hemagglutinin__InfluenzaA__ADJ80724

SEQ ID NO: 157711 - RNA, 1701 nt, Artificial Sequence; identical to SEQ ID NO: 156353
  derived and/or modified sequence opt4 from hemagglutinin__InfluenzaA__ADJ80734

SEQ ID NO: 157712 - RNA, 1701 nt, Artificial Sequence; identical to SEQ ID NO: 156353
  derived and/or modified sequence opt4 from hemagglutinin__InfluenzaA__ADJ80744

SEQ ID NO: 157713 - RNA, 1701 nt, Artificial Sequence; identical to SEQ ID NO: 156353
  derived and/or modified sequence opt4 from hemagglutinin__InfluenzaA__ADJ80754

SEQ ID NO: 157714 - RNA, 1701 nt, Artificial Sequence
  derived and/or modified sequence opt4 from hemagglutinin__InfluenzaA__ADJ80774
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccaacagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 157715 - RNA, 1701 nt, Artificial Sequence
  derived and/or modified sequence opt4 from hemagglutinin__InfluenzaA__ADJ80784
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccacaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157716 - RNA, 1701 nt, Artificial Sequence; identical to SEQ ID NO: 156353
  derived and/or modified sequence opt4 from hemagglutinin__InfluenzaA__ADJ80794

SEQ ID NO: 157717 - RNA, 1701 nt, Artificial Sequence; identical to SEQ ID NO: 157191
  derived and/or modified sequence opt4 from hemagglutinin__InfluenzaA__ADJ80804

SEQ ID NO: 157718 - RNA, 1701 nt, Artificial Sequence
  derived and/or modified sequence opt4 from hemagglutinin__InfluenzaA__ADJ80814
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugccccagagccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccaucgagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157719 - RNA, 1701 nt, Artificial Sequence
  derived and/or modified sequence opt4 from hemagglutinin__InfluenzaA__ADJ80834
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacagcggcagcggcaucaucaucagcgacacccccgugcacuacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157720 - RNA, 1701 nt, Artificial Sequence; identical to SEQ ID NO: 157391
  derived and/or modified sequence opt4 from hemagglutinin__InfluenzaA__ADJ80848

SEQ ID NO: 157721 - RNA, 1701 nt, Artificial Sequence
  derived and/or modified sequence opt4 from hemagglutinin__InfluenzaA__ADJ80858
augaagaccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157722 - RNA, 1701 nt, Artificial Sequence
  derived and/or modified sequence opt4 from hemagglutinin__InfluenzaA__ADJ80868
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugccccaacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcggcaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157723 - RNA, 1701 nt, Artificial Sequence; identical to SEQ ID NO: 156353
  derived and/or modified sequence opt4 from hemagglutinin__InfluenzaA__ADJ80883

SEQ ID NO: 157724 - RNA, 1701 nt, Artificial Sequence; identical to SEQ ID NO: 156353
  derived and/or modified sequence opt4 from hemagglutinin__InfluenzaA__ADJ80893

SEQ ID NO: 157725 - RNA, 1701 nt, Artificial Sequence; identical to SEQ ID NO: 156353
  derived and/or modified sequence opt4 from hemagglutinin__InfluenzaA__ADJ80910

SEQ ID NO: 157726 - RNA, 1701 nt, Artificial Sequence; identical to SEQ ID NO: 155189
  derived and/or modified sequence opt4 from hemagglutinin__InfluenzaA__ADJ80927

SEQ ID NO: 157727 - RNA, 1701 nt, Artificial Sequence
  derived and/or modified sequence opt4 from hemagglutinin__InfluenzaA__ADJ80937
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacgccuucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacaacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagagccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157728 - RNA, 1701 nt, Artificial Sequence; identical to SEQ ID NO: 156353
  derived and/or modified sequence opt4 from hemagglutinin__InfluenzaA__ADJ80947

SEQ ID NO: 157729 - RNA, 1701 nt, Artificial Sequence; identical to SEQ ID NO: 156353
  derived and/or modified sequence opt4 from hemagglutinin__InfluenzaA__ADJ80967

SEQ ID NO: 157730 - RNA, 1701 nt, Artificial Sequence; identical to SEQ ID NO: 156353
  derived and/or modified sequence opt4 from hemagglutinin__InfluenzaA__ADJ80977

SEQ ID NO: 157731 - RNA, 1701 nt, Artificial Sequence
  derived and/or modified sequence opt4 from hemagglutinin__InfluenzaA__ADJ80993
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugccccaacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157732 - RNA, 1701 nt, Artificial Sequence
  derived and/or modified sequence opt4 from hemagglutinin__InfluenzaA__ADJ81003
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157733 - RNA, 1701 nt, Artificial Sequence; identical to SEQ ID NO: 157391
  derived and/or modified sequence opt4 from hemagglutinin__InfluenzaA__ADJ81013

SEQ ID NO: 157734 - RNA, 1701 nt, Artificial Sequence
  derived and/or modified sequence opt4 from hemagglutinin__InfluenzaA__ADJ81023
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagauguuccccaagaccagcagcuggcccaaccacgacagcaacaagggcgugaccgccgccugcccccacgccggcgccaagagcuucuacaagaaccugaucuggcuggugaagaagggcaacagcuaccccaagcugaacaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157735 - RNA, 1701 nt, Artificial Sequence; identical to SEQ ID NO: 156353
  derived and/or modified sequence opt4 from hemagglutinin__InfluenzaA__ADJ81033

SEQ ID NO: 157736 - RNA, 1701 nt, Artificial Sequence; identical to SEQ ID NO: 155189
  derived and/or modified sequence opt4 from hemagglutinin__InfluenzaA__ADJ81043

SEQ ID NO: 157737 - RNA, 1701 nt, Artificial Sequence
  derived and/or modified sequence opt4 from hemagglutinin__InfluenzaA__ADJ81053
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157738 - RNA, 1701 nt, Artificial Sequence; identical to SEQ ID NO: 156353
  derived and/or modified sequence opt4 from hemagglutinin__InfluenzaA__ADJ81063

SEQ ID NO: 157739 - RNA, 1701 nt, Artificial Sequence; identical to SEQ ID NO: 156133
  derived and/or modified sequence opt4 from hemagglutinin__InfluenzaA__ADJ84772

SEQ ID NO: 157740 - RNA, 1701 nt, Artificial Sequence
  derived and/or modified sequence opt4 from hemagglutinin__InfluenzaA__ADJ88782
augaagaccaucaucgcccugagcuacaugcugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugggcgagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157741 - RNA, 1701 nt, Artificial Sequence
  derived and/or modified sequence opt4 from hemagglutinin__InfluenzaA__ADK21733
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcaccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157742 - RNA, 1701 nt, Artificial Sequence
  derived and/or modified sequence opt4 from hemagglutinin__InfluenzaA__ADK21743
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagaucagcaacagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157743 - RNA, 1701 nt, Artificial Sequence
  derived and/or modified sequence opt4 from hemagglutinin__InfluenzaA__ADK21753
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagggcaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157744 - RNA, 1701 nt, Artificial Sequence
  derived and/or modified sequence opt4 from hemagglutinin__InfluenzaA__ADK21763
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157745 - RNA, 1701 nt, Artificial Sequence; identical to SEQ ID NO: 156353
  derived and/or modified sequence opt4 from hemagglutinin__InfluenzaA__ADK21773

SEQ ID NO: 157746 - RNA, 1701 nt, Artificial Sequence; identical to SEQ ID NO: 156353
  derived and/or modified sequence opt4 from hemagglutinin__InfluenzaA__ADK21783

SEQ ID NO: 157747 - RNA, 1701 nt, Artificial Sequence; identical to SEQ ID NO: 155189
  derived and/or modified sequence opt4 from hemagglutinin__InfluenzaA__ADK21813

SEQ ID NO: 157748 - RNA, 1701 nt, Artificial Sequence; identical to SEQ ID NO: 156609
  derived and/or modified sequence opt4 from hemagglutinin__InfluenzaA__ADK21823

SEQ ID NO: 157749 - RNA, 1701 nt, Artificial Sequence
  derived and/or modified sequence opt4 from hemagglutinin__InfluenzaA__ADK21833
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugagagacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157750 - RNA, 1701 nt, Artificial Sequence; identical to SEQ ID NO: 156353
  derived and/or modified sequence opt4 from hemagglutinin__InfluenzaA__ADK21843

SEQ ID NO: 157751 - RNA, 1701 nt, Artificial Sequence; identical to SEQ ID NO: 155542
  derived and/or modified sequence opt4 from hemagglutinin__InfluenzaA__ADK21853

SEQ ID NO: 157752 - RNA, 1701 nt, Artificial Sequence; identical to SEQ ID NO: 156838
  derived and/or modified sequence opt4 from hemagglutinin__InfluenzaA__ADK21863

SEQ ID NO: 157753 - RNA, 1701 nt, Artificial Sequence; identical to SEQ ID NO: 155636
  derived and/or modified sequence opt4 from hemagglutinin__InfluenzaA__ADK21873

SEQ ID NO: 157754 - RNA, 1701 nt, Artificial Sequence
  derived and/or modified sequence opt4 from hemagglutinin__InfluenzaA__ADK21883
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccaaguacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157755 - RNA, 1701 nt, Artificial Sequence; identical to SEQ ID NO: 155189
  derived and/or modified sequence opt4 from hemagglutinin__InfluenzaA__ADK21893

SEQ ID NO: 157756 - RNA, 1701 nt, Artificial Sequence; identical to SEQ ID NO: 156786
  derived and/or modified sequence opt4 from hemagglutinin__InfluenzaA__ADK21903

SEQ ID NO: 157757 - RNA, 1701 nt, Artificial Sequence; identical to SEQ ID NO: 156899
  derived and/or modified sequence opt4 from hemagglutinin__InfluenzaA__ADK21913

SEQ ID NO: 157758 - RNA, 1701 nt, Artificial Sequence
  derived and/or modified sequence opt4 from hemagglutinin__InfluenzaA__ADK21923
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggccagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagagaagaucgacggcgugaagcuggagagcaccagaaucuaccagauccuggccaucuacagcaccguggccagcacccuggugcugguggugagccugggcgccaucagcuucuggaugugcagcaacggcagccugcagugcagaaucugcaucuga

SEQ ID NO: 157759 - RNA, 1701 nt, Artificial Sequence
  derived and/or modified sequence opt4 from hemagglutinin__InfluenzaA__ADK21933
augaaggccauccugguggugcugcuguacaccuucgccaccgccaacgccgacacccugugcaucggcuaccacgccaacaacagcaccgacaccguggacaccgugcuggagaagaacgugaccgugacccacagcguggaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugccccaacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157760 - RNA, 1701 nt, Artificial Sequence; identical to SEQ ID NO: 155189
  derived and/or modified sequence opt4 from hemagglutinin__InfluenzaA__ADK21943

SEQ ID NO: 157761 - RNA, 1701 nt, Artificial Sequence
  derived and/or modified sequence opt4 from hemagglutinin__InfluenzaA__ADK21953
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgaccacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcugugggccauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157762 - RNA, 1701 nt, Artificial Sequence; identical to SEQ ID NO: 157376
  derived and/or modified sequence opt4 from hemagglutinin__InfluenzaA__ADK32390

SEQ ID NO: 157763 - RNA, 1701 nt, Artificial Sequence; identical to SEQ ID NO: 157376
  derived and/or modified sequence opt4 from hemagglutinin__InfluenzaA__ADK32400

SEQ ID NO: 157764 - RNA, 1701 nt, Artificial Sequence
  derived and/or modified sequence opt4 from hemagglutinin__InfluenzaA__ADK32420
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccacagcaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157765 - RNA, 1701 nt, Artificial Sequence; identical to SEQ ID NO: 156741
  derived and/or modified sequence opt4 from hemagglutinin__InfluenzaA__ADK32430

SEQ ID NO: 157766 - RNA, 1701 nt, Artificial Sequence
  derived and/or modified sequence opt4 from hemagglutinin__InfluenzaA__ADK32440
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157767 - RNA, 1701 nt, Artificial Sequence
  derived and/or modified sequence opt4 from hemagglutinin__InfluenzaA__ADK32450
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcagcagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacgcccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggaggugggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccgccgccagcagccuggugcugguggugagccugggcgccaucagcuucuggaugugcagcaacggcagccugcagugcagaaucugcaucuga

SEQ ID NO: 157768 - RNA, 1701 nt, Artificial Sequence
  derived and/or modified sequence opt4 from hemagglutinin__InfluenzaA__ADK32460
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacgccuucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157769 - RNA, 1701 nt, Artificial Sequence; identical to SEQ ID NO: 156353
  derived and/or modified sequence opt4 from hemagglutinin__InfluenzaA__ADK32470

SEQ ID NO: 157770 - RNA, 1701 nt, Artificial Sequence
  derived and/or modified sequence opt4 from hemagglutinin__InfluenzaA__ADK32480
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgcccacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157771 - RNA, 1701 nt, Artificial Sequence; identical to SEQ ID NO: 156353
  derived and/or modified sequence opt4 from hemagglutinin__InfluenzaA__ADK32490

SEQ ID NO: 157772 - RNA, 1701 nt, Artificial Sequence; identical to SEQ ID NO: 156353
  derived and/or modified sequence opt4 from hemagglutinin__InfluenzaA__ADK32502

SEQ ID NO: 157773 - RNA, 1701 nt, Artificial Sequence; identical to SEQ ID NO: 156825
  derived and/or modified sequence opt4 from hemagglutinin__InfluenzaA__ADK32637

SEQ ID NO: 157774 - RNA, 1701 nt, Artificial Sequence; identical to SEQ ID NO: 156353
  derived and/or modified sequence opt4 from hemagglutinin__InfluenzaA__ADK32647

SEQ ID NO: 157775 - RNA, 1701 nt, Artificial Sequence; identical to SEQ ID NO: 156517
  derived and/or modified sequence opt4 from hemagglutinin__InfluenzaA__ADK32657

SEQ ID NO: 157776 - RNA, 1701 nt, Artificial Sequence; identical to SEQ ID NO: 156741
  derived and/or modified sequence opt4 from hemagglutinin__InfluenzaA__ADK32677

SEQ ID NO: 157777 - RNA, 1701 nt, Artificial Sequence
  derived and/or modified sequence opt4 from hemagglutinin__InfluenzaA__ADK32687
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagaacuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157778 - RNA, 1701 nt, Artificial Sequence; identical to SEQ ID NO: 156980
  derived and/or modified sequence opt4 from hemagglutinin__InfluenzaA__ADK32697

SEQ ID NO: 157779 - RNA, 1701 nt, Artificial Sequence; identical to SEQ ID NO: 156353
  derived and/or modified sequence opt4 from hemagglutinin__InfluenzaA__ADK32776

SEQ ID NO: 157780 - RNA, 1701 nt, Artificial Sequence; identical to SEQ ID NO: 156741
  derived and/or modified sequence opt4 from hemagglutinin__InfluenzaA__ADK33621

SEQ ID NO: 157781 - RNA, 1701 nt, Artificial Sequence
  derived and/or modified sequence opt4 from hemagglutinin__InfluenzaA__ADK33631
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggugaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucaacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157782 - RNA, 1701 nt, Artificial Sequence; identical to SEQ ID NO: 156741
  derived and/or modified sequence opt4 from hemagglutinin__InfluenzaA__ADK33641

SEQ ID NO: 157783 - RNA, 1701 nt, Artificial Sequence; identical to SEQ ID NO: 156353
  derived and/or modified sequence opt4 from hemagglutinin__InfluenzaA__ADK33651

SEQ ID NO: 157784 - RNA, 1701 nt, Artificial Sequence; identical to SEQ ID NO: 156353
  derived and/or modified sequence opt4 from hemagglutinin__InfluenzaA__ADK33661

SEQ ID NO: 157785 - RNA, 1701 nt, Artificial Sequence; identical to SEQ ID NO: 156353
  derived and/or modified sequence opt4 from hemagglutinin__InfluenzaA__ADK33671

SEQ ID NO: 157786 - RNA, 1701 nt, Artificial Sequence
  derived and/or modified sequence opt4 from hemagglutinin__InfluenzaA__ADK33681
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaagcuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157787 - RNA, 1701 nt, Artificial Sequence; identical to SEQ ID NO: 156802
  derived and/or modified sequence opt4 from hemagglutinin__InfluenzaA__ADK33691

SEQ ID NO: 157788 - RNA, 1701 nt, Artificial Sequence
  derived and/or modified sequence opt4 from hemagglutinin__InfluenzaA__ADK33701
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaguguaccagauccuggccaucuacagcaccguggccagcagccuggugcugguggugagccugggcgccaucagcuucuggaugugcagcaacggcagccugcagugcagaaucugcaucuga

SEQ ID NO: 157789 - RNA, 1701 nt, Artificial Sequence
  derived and/or modified sequence opt4 from hemagglutinin__InfluenzaA__ADK33711
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggagauccuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157790 - RNA, 1701 nt, Artificial Sequence
  derived and/or modified sequence opt4 from hemagglutinin__InfluenzaA__ADK33721
augaaggccauccugguggugcugcuguacaccuucgugaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157791 - RNA, 1701 nt, Artificial Sequence
  derived and/or modified sequence opt4 from hemagglutinin__InfluenzaA__ADK33731
augaaggccacccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacgccuucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugcuggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157792 - RNA, 1701 nt, Artificial Sequence; identical to SEQ ID NO: 157356
  derived and/or modified sequence opt4 from hemagglutinin__InfluenzaA__ADK33741

SEQ ID NO: 157793 - RNA, 1701 nt, Artificial Sequence; identical to SEQ ID NO: 155189
  derived and/or modified sequence opt4 from hemagglutinin__InfluenzaA__ADK33751

SEQ ID NO: 157794 - RNA, 1701 nt, Artificial Sequence
  derived and/or modified sequence opt4 from hemagglutinin__InfluenzaA__ADK33761
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagccuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157795 - RNA, 1701 nt, Artificial Sequence; identical to SEQ ID NO: 156353
  derived and/or modified sequence opt4 from hemagglutinin__InfluenzaA__ADK33771

SEQ ID NO: 157796 - RNA, 1701 nt, Artificial Sequence; identical to SEQ ID NO: 156353
  derived and/or modified sequence opt4 from hemagglutinin__InfluenzaA__ADK33781

SEQ ID NO: 157797 - RNA, 1701 nt, Artificial Sequence; identical to SEQ ID NO: 156290
  derived and/or modified sequence opt4 from hemagglutinin__InfluenzaA__ADK33791

SEQ ID NO: 157798 - RNA, 1701 nt, Artificial Sequence; identical to SEQ ID NO: 157788
  derived and/or modified sequence opt4 from hemagglutinin__InfluenzaA__ADK33801

SEQ ID NO: 157799 - RNA, 1701 nt, Artificial Sequence
  derived and/or modified sequence opt4 from hemagglutinin__InfluenzaA__ADK33811
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagcacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcaucaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157800 - RNA, 1701 nt, Artificial Sequence
  derived and/or modified sequence opt4 from hemagglutinin__InfluenzaA__ADK33821
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucaccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcuggccgugagccugggcgccaucagcuucuggaugugcagcaacggcagccugcagugcagaaucugcaucuga

SEQ ID NO: 157801 - RNA, 1701 nt, Artificial Sequence
  derived and/or modified sequence opt4 from hemagglutinin__InfluenzaA__ADK33831
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcaucgccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaacaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157802 - RNA, 1701 nt, Artificial Sequence; identical to SEQ ID NO: 156609
  derived and/or modified sequence opt4 from hemagglutinin__InfluenzaA__ADK33841

SEQ ID NO: 157803 - RNA, 1701 nt, Artificial Sequence; identical to SEQ ID NO: 157356
  derived and/or modified sequence opt4 from hemagglutinin__InfluenzaA__ADK33851

SEQ ID NO: 157804 - RNA, 1701 nt, Artificial Sequence; identical to SEQ ID NO: 155189
  derived and/or modified sequence opt4 from hemagglutinin__InfluenzaA__ADK33861

SEQ ID NO: 157805 - RNA, 1701 nt, Artificial Sequence
  derived and/or modified sequence opt4 from hemagglutinin__InfluenzaA__ADK33871
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccuggugauccccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugcuggugagccugggcgccaucagcuucuggaugugcagcaacggcagccugcagugcagaaucugcaucuga

SEQ ID NO: 157806 - RNA, 1701 nt, Artificial Sequence
  derived and/or modified sequence opt4 from hemagglutinin__InfluenzaA__ADK33881
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaacauccuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccaagaucuaccagauccuggccaucuacagcaccguggccagcagccuggugcugguggugagccugggcgccaucagcuucuggaugugcagcaacggcagccugcagugcagaaucugcaucuga

SEQ ID NO: 157807 - RNA, 1701 nt, Artificial Sequence
  derived and/or modified sequence opt4 from hemagglutinin__InfluenzaA__ADK33891
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcaucgccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaaaccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157808 - RNA, 1701 nt, Artificial Sequence; identical to SEQ ID NO: 157356
  derived and/or modified sequence opt4 from hemagglutinin__InfluenzaA__ADK33901

SEQ ID NO: 157809 - RNA, 1701 nt, Artificial Sequence
  derived and/or modified sequence opt4 from hemagglutinin__InfluenzaA__ADK33911
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggagggcaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcugaucaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157810 - RNA, 1701 nt, Artificial Sequence
  derived and/or modified sequence opt4 from hemagglutinin__InfluenzaA__ADK33931
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugcuggugagccugggcgccaucagcuucuggaugugcagcaacggcagccugcagugcagaaucugcaucuga

SEQ ID NO: 157811 - RNA, 1701 nt, Artificial Sequence
  derived and/or modified sequence opt4 from hemagglutinin__InfluenzaA__ADK33941
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucgugaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacaagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157812 - RNA, 1701 nt, Artificial Sequence; identical to SEQ ID NO: 157809
  derived and/or modified sequence opt4 from hemagglutinin__InfluenzaA__ADK33951

SEQ ID NO: 157813 - RNA, 1701 nt, Artificial Sequence; identical to SEQ ID NO: 156353
  derived and/or modified sequence opt4 from hemagglutinin__InfluenzaA__ADK33961

SEQ ID NO: 157814 - RNA, 1701 nt, Artificial Sequence; identical to SEQ ID NO: 156133
  derived and/or modified sequence opt4 from hemagglutinin__InfluenzaA__ADK45312

SEQ ID NO: 157815 - RNA, 1701 nt, Artificial Sequence
  derived and/or modified sequence opt4 from hemagglutinin__InfluenzaA__ADK45410
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacaccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157816 - RNA, 1701 nt, Artificial Sequence
  derived and/or modified sequence opt4 from hemagglutinin__InfluenzaA__ADK45421
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157817 - RNA, 1701 nt, Artificial Sequence
  derived and/or modified sequence opt4 from hemagglutinin__InfluenzaA__ADK45432
augaagaccaucaucgcccugagcuacacccugugccugguguucgcccagaagcugcccagaaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacaacccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157818 - RNA, 1701 nt, Artificial Sequence; identical to SEQ ID NO: 154954
  derived and/or modified sequence opt4 from hemagglutinin__InfluenzaA__ADK45443

SEQ ID NO: 157819 - RNA, 1701 nt, Artificial Sequence; identical to SEQ ID NO: 157353
  derived and/or modified sequence opt4 from hemagglutinin__InfluenzaA__ADK48798

SEQ ID NO: 157820 - RNA, 1701 nt, Artificial Sequence; identical to SEQ ID NO: 156353
  derived and/or modified sequence opt4 from hemagglutinin__InfluenzaA__ADK62683

SEQ ID NO: 157821 - RNA, 1701 nt, Artificial Sequence
  derived and/or modified sequence opt4 from hemagglutinin__InfluenzaA__ADK62693
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcggcagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagagcaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacgugcaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157822 - RNA, 1701 nt, Artificial Sequence; identical to SEQ ID NO: 156290
  derived and/or modified sequence opt4 from hemagglutinin__InfluenzaA__ADK62703

SEQ ID NO: 157823 - RNA, 1701 nt, Artificial Sequence
  derived and/or modified sequence opt4 from hemagglutinin__InfluenzaA__ADK64992
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcaucaagcuggagagcaccagaaucuaccagauccuggccaucuacagcaccguggccagcagccuggugcugguggugagccugggcgccaucagcuucuggaugugcagcaacggcagccugcaguacagaaucugcaucuga

SEQ ID NO: 157824 - RNA, 1701 nt, Artificial Sequence
  derived and/or modified sequence opt4 from hemagglutinin__InfluenzaA__ADK65001
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugggcggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugccuggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157825 - RNA, 1701 nt, Artificial Sequence
  derived and/or modified sequence opt4 from hemagglutinin__InfluenzaA__ADK65009
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucggcgccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157826 - RNA, 1701 nt, Artificial Sequence
  derived and/or modified sequence opt4 from hemagglutinin__InfluenzaA__ADK87287
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccugaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157827 - RNA, 1701 nt, Artificial Sequence
  derived and/or modified sequence opt4 from hemagglutinin__InfluenzaA__ADK87288
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccaccggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157828 - RNA, 1701 nt, Artificial Sequence
  derived and/or modified sequence opt4 from hemagglutinin__InfluenzaA__ADK87289
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccugggcuucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccugggcaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157829 - RNA, 1701 nt, Artificial Sequence
  derived and/or modified sequence opt4 from hemagglutinin__InfluenzaA__ADK87291
augaagaccaucaucgcccugagcuacauccagugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucagccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccugggcaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157830 - RNA, 1701 nt, Artificial Sequence
  derived and/or modified sequence opt4 from hemagglutinin__InfluenzaA__ADK87293
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccaggacggcaccagcagcgccugcaucagaagaagcaagaacagcuucuucagcaagcugaacuggcugacccaccugaacuucaaguaccccgcccugaacgugaccaugcccaacaacgagcaguucgacaagcuguacaucuggggcgugcaccaccccggcaccgacaaggaccagaccuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugagcaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157831 - RNA, 1701 nt, Artificial Sequence
  derived and/or modified sequence opt4 from hemagglutinin__InfluenzaA__ADK87295
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcagccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaagaaacaucugcaucuga

SEQ ID NO: 157832 - RNA, 1701 nt, Artificial Sequence
  derived and/or modified sequence opt4 from hemagglutinin__InfluenzaA__ADK87296
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagaugcgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157833 - RNA, 1701 nt, Artificial Sequence
  derived and/or modified sequence opt4 from hemagglutinin__InfluenzaA__ADK87298
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacagcggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaacaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaaccccgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157834 - RNA, 1701 nt, Artificial Sequence
  derived and/or modified sequence opt4 from hemagglutinin__InfluenzaA__ADK87300
augaagaccaucaucgcccugagcuacauccugugcaugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagccuguucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucgcccccaacggcagcauccccaacgacaagagcuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157835 - RNA, 1701 nt, Artificial Sequence
  derived and/or modified sequence opt4 from hemagglutinin__InfluenzaA__ADK87302
augaagaccaucaucgcccugagcuacauccugugcaugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcgacaucugcaucuga

SEQ ID NO: 157836 - RNA, 1701 nt, Artificial Sequence
  derived and/or modified sequence opt4 from hemagglutinin__InfluenzaA__ADK87304
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcggcugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacggccacgacguguacagagacgaggcccugaacaacagauuccagaucaagggcguggagcugaagagcggcuacaaggacugguuccuguggaucagcuucgccaucagcugcuuccugcugugcguggcccugcugggcuucaucaugugggccugccagaagggcaacaucagaugcaacaucugcaucuga

SEQ ID NO: 157837 - RNA, 1701 nt, Artificial Sequence
  derived and/or modified sequence opt4 from hemagglutinin__InfluenzaA__ADK87306
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccgccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucgugggcagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcgugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccauggaccagaucaacggcaagcugaacagacugaucggcaagaccaacgagaagcugcaccagaccgagaaggaguucagcgagguggagggcagaauccaggaccuggagaaguacguggaggacaccaagaucgaccuguggagcuacaacgccgagcugcugguggcccuggagagccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157838 - RNA, 1701 nt, Artificial Sequence
  derived and/or modified sequence opt4 from hemagglutinin__InfluenzaA__ADK87308
augaagaccaucaucgcccugagcuacauccugugcaugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugagaguggcccugcugggcuucaucaugugggccugccagaagggcaacaucagaugcaacaucugcaucuga

SEQ ID NO: 157839 - RNA, 1701 nt, Artificial Sequence
  derived and/or modified sequence opt4 from hemagglutinin__InfluenzaA__ADK87309
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugagcggcuucaucaugugggccugccagaagggcaacaucagaugcaacaucugcaucuga

SEQ ID NO: 157840 - RNA, 1701 nt, Artificial Sequence
  derived and/or modified sequence opt4 from hemagglutinin__InfluenzaA__ADK87310
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccggcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157841 - RNA, 1701 nt, Artificial Sequence
  derived and/or modified sequence opt4 from hemagglutinin__InfluenzaA__ADK87311
augaaggccauccugguggugcugcuguacaccuucgccaccgccaacgccgacacccugugcaucggcuaccacgccgacaacagcaccgacaccguggacaccgugcuggagagaaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccggccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagcccccccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157842 - RNA, 1701 nt, Artificial Sequence
  derived and/or modified sequence opt4 from hemagglutinin__InfluenzaA__ADK87313
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucgccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcggcugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugguuccuguggaucagcuucgccaucagcugcuuccugcugugcguggcccugcugggcuucaucaugugggccugccagaagggcaacaucagaugcaacaucugcaucuga

SEQ ID NO: 157843 - RNA, 1701 nt, Artificial Sequence
  derived and/or modified sequence opt4 from hemagglutinin__InfluenzaA__ADK87315
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagccccuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggagagcaaccaccuggagaccagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacagcaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157844 - RNA, 1701 nt, Artificial Sequence; identical to SEQ ID NO: 155987
  derived and/or modified sequence opt4 from hemagglutinin__InfluenzaA__ADK87317

SEQ ID NO: 157845 - RNA, 1701 nt, Artificial Sequence
  derived and/or modified sequence opt4 from hemagglutinin__InfluenzaA__ADK87319
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccgagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuacagaauccuggccaucuacagcaccguggccagcagccuggugcugguggugagccugggcgccaucagcuucuggaugugcagcaacggcagccugcagugcagaaucugcaucuga

SEQ ID NO: 157846 - RNA, 1701 nt, Artificial Sequence
  derived and/or modified sequence opt4 from hemagglutinin__InfluenzaA__ADK87321
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaugagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcguguacuggaccaucgugaagcccggcgacauccugcugaucaacagcaccggcaaccugaucgcccccagaggcuacuucaagaucagaagcggcaagagcagcaucaugagaagcgacgccagcaucggcaagugcaacagcggcugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguuccccgagguggagggcagaauccaggaccuggagaaguacguggaggacaccaagaucgaccuguggagcuacaacgccgagccccugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugguuccuguggaucagcuucgccaucagcugcuuccugcugugcguggcccugcugggcuucaucaugugggccugccagaagggcaacaucagaugcaacaucugcaucuga

SEQ ID NO: 157847 - RNA, 1701 nt, Artificial Sequence
  derived and/or modified sequence opt4 from hemagglutinin__InfluenzaA__ADK87323
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugggcaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157848 - RNA, 1701 nt, Artificial Sequence
  derived and/or modified sequence opt4 from hemagglutinin__InfluenzaA__ADK87325
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagacacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157849 - RNA, 1701 nt, Artificial Sequence
  derived and/or modified sequence opt4 from hemagglutinin__InfluenzaA__ADK87326
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcugcaaggacuggauccuguggaucagcuucgccaucagcugcuuccugcugugcguggcccugcugggcuucaccaugugggccugccagaagggcaacaucagaugcaacaucugcaucuga

SEQ ID NO: 157850 - RNA, 1701 nt, Artificial Sequence
  derived and/or modified sequence opt4 from hemagglutinin__InfluenzaA__ADK87328
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagagcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157851 - RNA, 1701 nt, Artificial Sequence
  derived and/or modified sequence opt4 from hemagglutinin__InfluenzaA__ADK87334
augaagaccaucaucgcccugagcuacauccugugccugguguucgcccagaagcugcccggcaacgacaacagcaccgccacccugugccugggccaccacgccgugcccaacggcaccaucgugaagaccaucaccagcgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcaagcugaacuggcugacccaccugaacuucaaguaccccgcccugaacgugaccaugcccaacaacgagcaguucgacaagcuguacaucuggggcgugagacaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaccuacuggaccaucgugaagcccggcgacauccugcugaucaacagcaccggcaaccugaucgcccccagaggcuacuucaagaucagaagcggcaagagcagcaucaugagaagcgacacccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157852 - RNA, 1701 nt, Artificial Sequence
  derived and/or modified sequence opt4 from hemagglutinin__InfluenzaA__ADK87336
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcaagcugaacuggcugacccaccugaacuucaaguaccccgcccugaacgugaccaugcccaacaacgagcaguucgacaagcuguacaucuggggcgugcaccaccccggcaccgacagagaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacacccccaucggcaagagcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagaggacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157853 - RNA, 1701 nt, Artificial Sequence; identical to SEQ ID NO: 155189
  derived and/or modified sequence opt4 from hemagglutinin__InfluenzaA__ADK87338

SEQ ID NO: 157854 - RNA, 1701 nt, Artificial Sequence
  derived and/or modified sequence opt4 from hemagglutinin__InfluenzaA__ADK90193
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaagguggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157855 - RNA, 1701 nt, Artificial Sequence
  derived and/or modified sequence opt4 from hemagglutinin__InfluenzaA__ADK90194
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcaaguacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157856 - RNA, 1701 nt, Artificial Sequence
  derived and/or modified sequence opt4 from hemagglutinin__InfluenzaA__ADK90195
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucgugaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagaucgacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157857 - RNA, 1701 nt, Artificial Sequence; identical to SEQ ID NO: 155176
  derived and/or modified sequence opt4 from hemagglutinin__InfluenzaA__ADK90196

SEQ ID NO: 157858 - RNA, 1701 nt, Artificial Sequence
  derived and/or modified sequence opt4 from hemagglutinin__InfluenzaA__ADK90197
augagagccauccugggcgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157859 - RNA, 1701 nt, Artificial Sequence
  derived and/or modified sequence opt4 from hemagglutinin__InfluenzaA__ADK90198
augaaggccauccugggcgugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157860 - RNA, 1701 nt, Artificial Sequence; identical to SEQ ID NO: 155189
  derived and/or modified sequence opt4 from hemagglutinin__InfluenzaA__ADK90199

SEQ ID NO: 157861 - RNA, 1701 nt, Artificial Sequence
  derived and/or modified sequence opt4 from hemagglutinin__InfluenzaA__ADK90200
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucgccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccguguacagcaccguggccagcagccuggugcugguggugagccugggcgccaucagcuucuggaugugcagcaacggcagccugcagugcagaaucugcaucuga

SEQ ID NO: 157862 - RNA, 1701 nt, Artificial Sequence
  derived and/or modified sequence opt4 from hemagglutinin__InfluenzaA__ADK90201
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccgugagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157863 - RNA, 1701 nt, Artificial Sequence
  derived and/or modified sequence opt4 from hemagglutinin__InfluenzaA__ADK90202
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagccccugagcaccgccagcagcuggagcuacaucguggagaccagcagcagcgacaacggcaccugcuaccccggcgacuucaucgacuacgaggagcugagagagcagcugagcagcgugagcagcuucgagagacuggagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaacggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157864 - RNA, 1701 nt, Artificial Sequence; identical to SEQ ID NO: 155369
  derived and/or modified sequence opt4 from hemagglutinin__InfluenzaA__ADK90203

SEQ ID NO: 157865 - RNA, 1701 nt, Artificial Sequence; identical to SEQ ID NO: 156290
  derived and/or modified sequence opt4 from hemagglutinin__InfluenzaA__ADK90204

SEQ ID NO: 157866 - RNA, 1701 nt, Artificial Sequence
  derived and/or modified sequence opt4 from hemagglutinin__InfluenzaA__ADK94191
augaagaccaucaucgcccugagcuacauccugugccugguguucgcccagaagcugcccggcaacgacaacagcaccgccacccugugccugggccaccacgccgugcccaacggcaccguggugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagagugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157867 - RNA, 1701 nt, Artificial Sequence
  derived and/or modified sequence opt4 from hemagglutinin__InfluenzaA__ADK94202
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157868 - RNA, 1701 nt, Artificial Sequence; identical to SEQ ID NO: 154954
  derived and/or modified sequence opt4 from hemagglutinin__InfluenzaA__ADK94213

SEQ ID NO: 157869 - RNA, 1701 nt, Artificial Sequence; identical to SEQ ID NO: 156133
  derived and/or modified sequence opt4 from hemagglutinin__InfluenzaA__ADK94224

SEQ ID NO: 157870 - RNA, 1701 nt, Artificial Sequence
  derived and/or modified sequence opt4 from hemagglutinin__InfluenzaA__ADK94257
auggagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157871 - RNA, 1701 nt, Artificial Sequence
  derived and/or modified sequence opt4 from hemagglutinin__InfluenzaA__ADK94268
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157872 - RNA, 1701 nt, Artificial Sequence
  derived and/or modified sequence opt4 from hemagglutinin__InfluenzaA__ADK94279
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157873 - RNA, 1701 nt, Artificial Sequence; identical to SEQ ID NO: 156133
  derived and/or modified sequence opt4 from hemagglutinin__InfluenzaA__ADK94290

SEQ ID NO: 157874 - RNA, 1701 nt, Artificial Sequence; identical to SEQ ID NO: 156133
  derived and/or modified sequence opt4 from hemagglutinin__InfluenzaA__ADK94301

SEQ ID NO: 157875 - RNA, 1701 nt, Artificial Sequence
  derived and/or modified sequence opt4 from hemagglutinin__InfluenzaA__ADK94323
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagaaucagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157876 - RNA, 1701 nt, Artificial Sequence; identical to SEQ ID NO: 157866
  derived and/or modified sequence opt4 from hemagglutinin__InfluenzaA__ADK94441

SEQ ID NO: 157877 - RNA, 1701 nt, Artificial Sequence
  derived and/or modified sequence opt4 from hemagglutinin__InfluenzaA__ADK94476
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgcccaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157878 - RNA, 1701 nt, Artificial Sequence; identical to SEQ ID NO: 156133
  derived and/or modified sequence opt4 from hemagglutinin__InfluenzaA__ADK94487

SEQ ID NO: 157879 - RNA, 1701 nt, Artificial Sequence
  derived and/or modified sequence opt4 from hemagglutinin__InfluenzaA__ADK94498
augaagaccaucaucgcccugagcuacauccugugccugguguucgcccagaagcugcccggcaacgacaacagcaccgccacccugugccugggccaccacgccgugcccaacggcaccguggugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157880 - RNA, 1701 nt, Artificial Sequence
  derived and/or modified sequence opt4 from hemagglutinin__InfluenzaA__ADK94509
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacaucaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157881 - RNA, 1701 nt, Artificial Sequence
  derived and/or modified sequence opt4 from hemagglutinin__InfluenzaA__ADK94520
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaucagaagaagcaacaacagcuucuucagcagacugaacuggcugacccaccugagauucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucaagugcaacaucugcaucuga

SEQ ID NO: 157882 - RNA, 1701 nt, Artificial Sequence; identical to SEQ ID NO: 156133
  derived and/or modified sequence opt4 from hemagglutinin__InfluenzaA__ADK94531

SEQ ID NO: 157883 - RNA, 1701 nt, Artificial Sequence; identical to SEQ ID NO: 154954
  derived and/or modified sequence opt4 from hemagglutinin__InfluenzaA__ADK94542

SEQ ID NO: 157884 - RNA, 1701 nt, Artificial Sequence
  derived and/or modified sequence opt4 from hemagglutinin__InfluenzaA__ADK94553
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcaacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157885 - RNA, 1701 nt, Artificial Sequence; identical to SEQ ID NO: 156133
  derived and/or modified sequence opt4 from hemagglutinin__InfluenzaA__ADK94564

SEQ ID NO: 157886 - RNA, 1701 nt, Artificial Sequence
  derived and/or modified sequence opt4 from hemagglutinin__InfluenzaA__ADK98501
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcggcaacggcaccugcuaccccggcgacuucaucgacuacgaggagcugagagagcagcugagcagcgugagcagcuucgagagauucgagaucuuccccaagaccagcagcuggcccaaccacgacagcaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacgccgacgccuacguguucgugggcaccagcagauacagcaagaaguucaagcccgagaucgccaucagacccaaggugagagaccaggagggcagaaugaacuacuacuggacccugguggagcccggcgacaagaucaccuucgagaccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157887 - RNA, 1701 nt, Artificial Sequence
  derived and/or modified sequence opt4 from hemagglutinin__InfluenzaA__ADK98503
augaaggccauccugguggugcugcuguacaccuucgccaccgccaacgccgacacccugugcaucggcuaccacgccaacaacagcaccgacaccguggacaccgugcuggagaagaacgugaccgugacccacagcgugaaccugcuggaggacaagcacaacggcaagcugugcaagcugagaggcguggccccccugcaccugggcaagugcaacaucgccggcuggauccugggcaaccccgagugcgagagccugagcaccgccagcagcuggagcuacaucguggagaccagcagcagcgacaacggcaccugcuaccccggcgacuucaucgacuacgaggagcugagagagcagcugagcagcgugagcagcuucgagagauucgagaucuuccccaagaccagcagcuggcccaaccacgaccccaacaagggcgugaccgccgccugcccccacgccggcgccaagagcuucuacaagaaccugaucuggcuggugaagaagggcaacagcuaccccaagcugagcaagagcuacaucaacgacaagggcaaggaggugcuggugcuguggggcauccaccaccccagcaccagcgccgaccagcagagccuguaccagaacguggacgccuacguguucgugggcaccagcagauacagcaagaaguucaagcccgagaucgccaucagacccaaggugagagaccaggagggcagaaugaacuacuacuggacccugguggagcccggcgacaagaucaccuucgaggccaccggcaaccugguggugcccagauacgccuucgccauggagagaaacgccggcagcggcaucaucaucagcgacacccccgugcacgacugcaacaccaccugccagacccccaagggcgccaucaacaccagccugcccuuccagaacauccaccccaucaccaucggcaagugccccaaguacgugaagagcaccaagcugagacuggccaccggccugagaaacgugcccagcauccagagcagaggccuguucggcgccaucgccggcuucaucgagggcggcuggaccggcaugguggacggcugguacggcuaccaccaccagaacgagcagggcagcggcuacgccgccgaccugaagagcacccagaacgccaucgacgagaucaccaacaaggugaacagcgugaucgagaagaugaacacccaguucaccgccgugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacaacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcgccaucagcuucuggaugugcagcaacggcagccugcagugcagaaucugcaucuga

SEQ ID NO: 157888 - RNA, 1701 nt, Artificial Sequence; identical to SEQ ID NO: 157871
  derived and/or modified sequence opt4 from hemagglutinin__InfluenzaA__ADK98623

SEQ ID NO: 157889 - RNA, 1701 nt, Artificial Sequence; identical to SEQ ID NO: 154954
  derived and/or modified sequence opt4 from hemagglutinin__InfluenzaA__ADK98634

SEQ ID NO: 157890 - RNA, 1701 nt, Artificial Sequence; identical to SEQ ID NO: 154954
  derived and/or modified sequence opt4 from hemagglutinin__InfluenzaA__ADK98645

SEQ ID NO: 157891 - RNA, 1701 nt, Artificial Sequence; identical to SEQ ID NO: 157817
  derived and/or modified sequence opt4 from hemagglutinin__InfluenzaA__ADK98656

SEQ ID NO: 157892 - RNA, 1701 nt, Artificial Sequence; identical to SEQ ID NO: 157884
  derived and/or modified sequence opt4 from hemagglutinin__InfluenzaA__ADK98667

SEQ ID NO: 157893 - RNA, 1701 nt, Artificial Sequence
  derived and/or modified sequence opt4 from hemagglutinin__InfluenzaA__ADK98678
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccagaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157894 - RNA, 1701 nt, Artificial Sequence; identical to SEQ ID NO: 154954
  derived and/or modified sequence opt4 from hemagglutinin__InfluenzaA__ADK98689

SEQ ID NO: 157895 - RNA, 1701 nt, Artificial Sequence; identical to SEQ ID NO: 154954
  derived and/or modified sequence opt4 from hemagglutinin__InfluenzaA__ADK98700

SEQ ID NO: 157896 - RNA, 1701 nt, Artificial Sequence; identical to SEQ ID NO: 154954
  derived and/or modified sequence opt4 from hemagglutinin__InfluenzaA__ADK98711

SEQ ID NO: 157897 - RNA, 1701 nt, Artificial Sequence
  derived and/or modified sequence opt4 from hemagglutinin__InfluenzaA__ADK98722
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagggcagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157898 - RNA, 1701 nt, Artificial Sequence; identical to SEQ ID NO: 157871
  derived and/or modified sequence opt4 from hemagglutinin__InfluenzaA__ADK98733

SEQ ID NO: 157899 - RNA, 1701 nt, Artificial Sequence; identical to SEQ ID NO: 154954
  derived and/or modified sequence opt4 from hemagglutinin__InfluenzaA__ADK98744

SEQ ID NO: 157900 - RNA, 1701 nt, Artificial Sequence; identical to SEQ ID NO: 154954
  derived and/or modified sequence opt4 from hemagglutinin__InfluenzaA__ADK98777

SEQ ID NO: 157901 - RNA, 1701 nt, Artificial Sequence; identical to SEQ ID NO: 154954
  derived and/or modified sequence opt4 from hemagglutinin__InfluenzaA__ADK98788

SEQ ID NO: 157902 - RNA, 1701 nt, Artificial Sequence; identical to SEQ ID NO: 156133
  derived and/or modified sequence opt4 from hemagglutinin__InfluenzaA__ADK98799

SEQ ID NO: 157903 - RNA, 1701 nt, Artificial Sequence
  derived and/or modified sequence opt4 from hemagglutinin__InfluenzaA__ADK98810
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaccuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaaggagguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157904 - RNA, 1701 nt, Artificial Sequence
  derived and/or modified sequence opt4 from hemagglutinin__InfluenzaA__ADK98821
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcaagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaagaacagcuucuucagcagacugaacuggcugacccaccugaacuucaaguaccccgcccugaacgugaccaugcccaacaacgagcaguucgacaagcuguacaucuggggcgugcaccaccccggcaccgacaaggaccagaucuuccuguacgcccaggccagcggcagaaucaccgugagcaccaagagaagccagcagaccgccauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157905 - RNA, 1701 nt, Artificial Sequence; identical to SEQ ID NO: 154954
  derived and/or modified sequence opt4 from hemagglutinin__InfluenzaA__ADK98832

SEQ ID NO: 157906 - RNA, 1701 nt, Artificial Sequence; identical to SEQ ID NO: 157884
  derived and/or modified sequence opt4 from hemagglutinin__InfluenzaA__ADK98843

SEQ ID NO: 157907 - RNA, 1701 nt, Artificial Sequence
  derived and/or modified sequence opt4 from hemagglutinin__InfluenzaA__ADK98854
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcaacaacagcuucuucagcagacugaacuggcugacccaccugaaguucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagcccggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 157908 - RNA, 1701 nt, Artificial Sequence
  derived and/or modified sequence opt4 from hemagglutinin__InfluenzaA__ADK98865
augaagaccaucaucgcccugagcuacauccugugccugguguucgcccagaagcugcccggcagcgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacgacuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaucagaagaagcagcaacagcuucuucagcagacugaacuggcugacccaccugagauucaaguaccccgcccugaacgugaccaugcccaacaacgagcaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcagaggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga
